United States Patent 11,446,398 (REGULATED BIOCIRCUIT SYSTEMS) - sequence listing, part 76

SEQ ID NO: 178051 - DNA, 7326 bp, Homo sapiens
  Payload ID: 14927
  Gene Symbol: RTTN
  Gene Name: rotatin
  Uniprot ID: Q86VV8
  ENST ID: ENST00000255674
  CDS Start-End: 288-6968
ggccaacgctggttctatccctgcttgttgcttttttttttccctccgcttcttgcgacggagactgctgtccaggaagtgcgcagtagtgattctagagaggctggaagctctcctggcgacgctggggccgcgaagggctcacgtaatgactcctactcctggtgagcgcaggcgttgcggaactcaccgtcccacaggacgtgtttccgggggtacattaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacatttccttggctacccctgaccaccacagacagacatgtcctctcctctaatgaaagctctttaagaagtagtaaccacactttaatctggaacacctgtgaactattgaaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaaggcaagcgagtttttatcagagcctatgtcaacagcattatttctcctttctttggacatgcctatttctttggaatatccaaatattcatgaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaaggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtttgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaactaaaaattgactaataa

SEQ ID NO: 178052 - DNA, 911 bp, Homo sapiens
  Payload ID: 14927
  Gene Symbol: RTTN
  Gene Name: rotatin
  ENST ID: ENST00000578780
  CDS Start-End: 1-554
tggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaactaaaaa

SEQ ID NO: 178053 - DNA, 6278 bp, Homo sapiens
  Payload ID: 14927
  Gene Symbol: RTTN
  Gene Name: rotatin
  ENST ID: ENST00000583043
  CDS Start-End: 1-2010
aaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaaggcaagcgagtttttatcagagcctatgtcaacagcattatttctcctttctttggacatgcctatttctttggaatatccaaatattcatgaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaaggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtttgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaactaaaaa

SEQ ID NO: 178054 - DNA, 6722 bp, Homo sapiens
  Payload ID: 14927
  Gene Symbol: RTTN
  Gene Name: rotatin
  ENST ID: ENST00000581161
  CDS Start-End: 43-1545
cggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacatttccttggctacccctgaccaccacagacagacatgtcctctcctctaatgaaagctctttaagaagtagtaaccacactttaatctggaacacctgtgaactattgaaggatgttatcatgcaagattttcctgctgagattttccttcaaaggccaaaaattgttcagagccttttatctctgttgaaactggcctttggagatggaaagcatcgcctggcattacagtcggtgtcctgcctgcagcagctgtgcatgtatttaagaaacagacttaactttcaccgagatccaggttttttctccaataaacacgacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctagtggaagtagtagtcatgctcatgtaaactccaggatatccgttcattcacctttggatatgggacacatagatctgccagagctggaaactgaagacacattggaactacaattccagcagctcagtcttccccagttttgtgtctccattctggaatcagctgttcctctcttaagaacaggtagcagacaagtgataataagagttctggaattgcttacagaggatatgacacttattggtgaagcaatttcaacagatatctgggatgacagcagcctttttggtatagatatgaaggagaaactactcctggtgttgggagcccttggagaaaccatgtgctaccataaaagtagtatcagtttggagcagccagaggtgatgcttgtgcaccacagaatggcctttatcagcatttccctgtttgcagttcgactgctacaaacgcttctccctgttgaaaagctgttgtggcctatttggaacagctgaattctgaaaactacagtatttataaacgaactgcagaggccgtttattcaattgaatgcacctgtaacttcctgtctgatattgggaaagagggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggcaacaacttcagaaagaactgattgctctttttgataccttgctgctcaatttcatggaagttactgacaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtttagatgactcattcaagttttggagggctccatctaggacaagtcaggatcgagatccaagttctctctccacctcagaaacaacggtggcaccttcattggggagtactgaatttcagccacttgtgcagtcaacaacacttctacctgaagcctcccatgaccagtttgtggctcaaggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtttgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctct

SEQ ID NO: 178055 - DNA, 6621 bp, Homo sapiens
  Payload ID: 14928
  Gene Symbol: RSBN1
  Gene Name: round spermatid basic protein 1
  Uniprot ID: Q5VWQ0
  ENST ID: ENST00000261441
  CDS Start-End: 65-2473
gctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 178056 - DNA, 3772 bp, Homo sapiens
  Payload ID: 14928
  Gene Symbol: RSBN1
  Gene Name: round spermatid basic protein 1
  ENST ID: ENST00000476412
  CDS Start-End: 26-1261
atttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcagtagagagagcaggagcagccaatgtggagaggtcgcaagatggggctgcccaagatgttggaacaccatgtgcaataaagggcttcgtcttggattttggccttattaccacaaccaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaa

SEQ ID NO: 178057 - DNA, 2703 bp, Homo sapiens
  Payload ID: 14928
  Gene Symbol: RSBN1
  Gene Name: round spermatid basic protein 1
  ENST ID: ENST00000616024
  CDS Start-End: 8-2065
gggtgaaatggctgcgcaggtcggagcgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttc

SEQ ID NO: 178058 - DNA, 6592 bp, Homo sapiens
  Payload ID: 14928
  Gene Symbol: RSBN1
  Gene Name: round spermatid basic protein 1
  Uniprot ID: Q5VWQ0
  ENST ID: ENST00000612242
  CDS Start-End: 37-2445
gcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttt

SEQ ID NO: 178059 - DNA, 2418 bp, Homo sapiens
  Payload ID: 14928
  Gene Symbol: RSBN1
  Gene Name: round spermatid basic protein 1
  ENST ID: ENST00000615321
  CDS Start-End: 22-2286
aaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccac

SEQ ID NO: 178060 - DNA, 6422 bp, Homo sapiens
  Payload ID: 14929
  Gene Symbol: RSBN1L
  Gene Name: round spermatid basic protein 1-like
  Uniprot ID: Q6PCB5
  ENST ID: ENST00000334955
  CDS Start-End: 28-2568
ggagagtaaatacaacaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtggtgcgatctcggctcactgcaacctctgcctctcgggttcaagtgattattctcctgcctcagcctcctgagtagctgggactacaggcacgcaccacaacacccagctaatttttgtatttttagtagagatggggtttcatcatgttggccaggatggtcttgatctcttgaccttgtgatccgcccaccttggcctcccaaagtgctgggattgcaggggtgagccacagcgcccagcctatgcaggcatttttaacaaccaagactcagttaagaaagtgtgcatctgcgtgtgtgtgaatgtgtatatatatgtatatatatatcatattttgcataattttcttaaattgctgaataagatcaatatgtgaaattccttagcccttctccccaaaatacattgaaaaaagttttatattaaactattaagaaagcagtttaggtaatagaaacagttttagaaagttgggagaaacaaggtatgttaatgataacaaaggcttctaactaatagttacgtggccagattacatagcctaccatagattttttttattgtgtatgggatgataagaagtttagagaattttcttactagtaagtacctttactaagtaatagctaagtataaaatctttagttacagaaagcttgtgagcaattaaaatccttttacatttttcttgcagaatgggagaaaaatatggcaaatacaaaactgtaaaataagggcaatgacaatgactcaactgccatatagagatataattaacaaaatactttgtggtacctcttatctctcaggatctcctccctaccctagcaaggcaaacaacttggagtacttccttttcgaaagaagttctagaaattaaattgaggtaggagacggattgacagtgcctaactaaagatgagtaaaacagacctctttaatgatagactcactatttgacactgcttctactattgtaattaaaaatcagaagtctttgatgtatgcgttgctgtaagaaactctgctcattgcaaatctattttgtttgtttttggtattattctgggcacatactttggttgatgactttcaattggggttctttgtgctgccttttgggttactgttggtatttccatttctggcttaatttatggtaaccatcaaaactgcttatatttctggttagggcgaagccatttaggaagaagcatttcaccagaacaagtaaaagttaattgcagcaatgatgtcagttttggcccctagtttaataaaaggataggcaaatatcataggaaatcttcatggtttgtaggaaatcagtgtttgcaacgtaggaagtttcatgggatagggaaggtataaatcaagatagtaagggttttgttttatatgtcattgtcttaccatgctccccacctatttaatcttctgttttaagctaaatttatggatttgcacctacctttttgagtggcagaagttcttaacaaaccagtattgagaaataagaagggatgtagttaaaatggttttctgtttctctttaaagttgaagaatgatatatttaacaagagttgtgttttatttccagttttccagtagcatatatgtagatgcattgaggtcatactgtgagaaaatgtctttagggtatccctccaaaataggagccttaaactttttaacttaaaggaaggcatatctaaaaaccatagtggttgcttttaggtatagtttcctatataacctatagtcagacttatctataatatgaaaatttaattgttttaaaaatgcatacatcggccgggtgcagtggctcacgcctgtaatcccagcacttagggaggccgaggcgggcggatcacgaggtcagaagtttgagaccagtctggccaacatggtgaaaccccgtctctactaaaaatacaaaaaaattagttgggcgtggtggcgtgcgcctgtaatcccagctacttgggaggctgaggcaggggaattgcttgaacccgggaggagaaggttgcagtgagccgagatcgccccactgccctccagcctgggcgacagtctcaaaaaaaaaaaaaaaaaaaagcatacatctctgaaggtaaagtataaatcagtgggctcaagatttgcaggtacagccttgttaatgccttcaataatgcttacgttccttgtcttatgggttataattttcacatcctcttcagatacaatctgagaacttgttgactacctttgttacatgcaaaaattttctattttaatattgcattatattaatggtttcatagtacattccagttctttatctgaatacaagcgttttgcttttatttccagtttcttggaccagaacaataaaatacataagacatcgtttctatatggtcatatactatatagaataaagaattgttatgtaaattattaaatgagtatacagacctttacataaaaactaaggtacctcagtggaatctgctacagtgcttccccctccctacccctccattttgtttataaccttttagctatctaaataatacgtattccatactcaggatagctggttagctagcaaaagaattaacatttgtgatatttacttgcaaactttactgaagccatattcattatcttccttgtcaccaaggctgttgaccttaaataaacattaagttgattttgcacaacactgtatttgtgtgtgtgcatgtgcctgtttttgtgtgtgtatgtttgtgggaaataattatgtttgtttccgcatatattcatttttaatgcattctgtaacttttctcgagtggtggtcattgagggtagggaagattttattttttaagttgtcgttaaggtatttcattagtgttcctgagtgtaaaacagttttttcccaaatacttatggcagataagagcatttttgtaaataataaactagcaccgtttgggtaaatttgcattattttttggacaggttcattgtcatgtaaaacaaatatctcaaaattcattttacatttagcaaaggtgcaacatttgtttttggagtttgagagatattttccttgtcttccatcattcaataaatactaaaattgataaccaca

SEQ ID NO: 178061 - DNA, 2667 bp, Homo sapiens
  Payload ID: 14929
  Gene Symbol: RSBN1L
  Gene Name: round spermatid basic protein 1-like
  Uniprot ID: Q6PCB5
  ENST ID: ENST00000445288
  CDS Start-End: 423-2153
cgtgcgccggcctggaggggctgggaggcgtccggttttcagcagaggattttgcagttcccaaggggacaggaaatggagcctgtaatttcggttgcagagagggggatggccgacactcttattttctgtatcgtttcttcctcccagttagtgcgctgcaggatttgtgaaaatccatcttgaggactctcctagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgt

SEQ ID NO: 178062 - DNA, 605 bp, Homo sapiens
  Payload ID: 14929
  Gene Symbol: RSBN1L
  Gene Name: round spermatid basic protein 1-like
  ENST ID: ENST00000441514
  CDS Start-End: 1-534
tgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaa

SEQ ID NO: 178063 - DNA, 784 bp, Homo sapiens
  Payload ID: 14929
  Gene Symbol: RSBN1L
  Gene Name: round spermatid basic protein 1-like
  ENST ID: ENST00000445512
  CDS Start-End: 187-784
cagaattgaatcaacagcttctgctcccacccccctcaattctttggctctaataatgatcctgtttttgtattttcttcacattggtgctgatacaagctaaaaatatctgtatctccatatttatggtggatcactatgaaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgata

SEQ ID NO: 178064 - DNA, 3077 bp, Homo sapiens
  Payload ID: 14929
  Gene Symbol: RSBN1L
  Gene Name: round spermatid basic protein 1-like
  ENST ID: ENST00000614027
  CDS Start-End: 28-2559
ggagagtaaatacaacaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatagaaagaaagataacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaag

SEQ ID NO: 178065 - DNA, 7501 bp, Homo sapiens
  Payload ID: 14930
  Gene Symbol: ROBO1
  Gene Name: roundabout guidance receptor 1
  ENST ID: ENST00000436010
  CDS Start-End: 1239-5834
aattgagctggagaggaggcagcgtgagagcagaaacttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaatgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctggtaatcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctc

SEQ ID NO: 178066 - DNA, 4841 bp, Homo sapiens
  Payload ID: 14930
  Gene Symbol: ROBO1
  Gene Name: roundabout guidance receptor 1
  Uniprot ID: Q9Y6N7
  ENST ID: ENST00000467549
  CDS Start-End: 84-4739
gtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcaga

SEQ ID NO: 178067 - DNA, 577 bp, Homo sapiens
  Payload ID: 14930
  Gene Symbol: ROBO1
  Gene Name: roundabout guidance receptor 1
  ENST ID: ENST00000495961
  CDS Start-End: 1-577
gtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaaggtaaagtaaatgaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaag

SEQ ID NO: 178068 - DNA, 569 bp, Homo sapiens
  Payload ID: 14930
  Gene Symbol: ROBO1
  Gene Name: roundabout guidance receptor 1
  ENST ID: ENST00000472273
  CDS Start-End: 1-569
tatttcagaactctgatttattgtttatactgcttgtaagcagatttggtatgtcagaccataataaagaacctggaatgcaactagacgacagattattactgactacattccagtggcaagcttatcatttggattttcacctttgcctaaattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctg

SEQ ID NO: 178069 - DNA, 444 bp, Homo sapiens
  Payload ID: 14930
  Gene Symbol: ROBO1
  Gene Name: roundabout guidance receptor 1
  ENST ID: ENST00000492990
  CDS Start-End: 32-157
tggctggttgtaatgcaaggaagggacaaagatgaaatggaaacatgttccttttttggtcatgatatcactcctcagcttatccccaaatcacctgtttctggcccagcttattccagggctcaagcctactaaagaaccaagaaaaattctgtaatacaataaaattcgtctccaccctttttaatggtttaaaggatcaattcttctccaagcccatcactgaccttcctgctgaacttcaactggatgcaaaacaaacccacaaattctattttagagaattatggaagtcaaatgacgtatgtattcaggtcacagaaaatgtatgatgcatggtgccatttaaaaaaatatttgctctgtgaagatctgctttctgcattatggaagaaaagcaattcatatttttcaacggcttgcattaaaatcctacactgtgta

SEQ ID NO: 178070 - DNA, 6742 bp, Homo sapiens
  Payload ID: 14930
  Gene Symbol: ROBO1
  Gene Name: roundabout guidance receptor 1
  Uniprot ID: Q9Y6N7
  ENST ID: ENST00000464233
  CDS Start-End: 115-5070
aaagttgcagggctgcgtctgcactacggagcctctagattgctgaaaacagtcttatggaaggataacacattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 178071 - DNA, 5600 bp, Homo sapiens
  Payload ID: 14930
  Gene Symbol: ROBO1
  Gene Name: roundabout guidance receptor 1
  Uniprot ID: Q9Y6N7
  ENST ID: ENST00000495273
  CDS Start-End: 555-5375
tcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttgg

SEQ ID NO: 178072 - DNA, 7492 bp, Homo sapiens
  Payload ID: 14930
  Gene Symbol: ROBO1
  Gene Name: roundabout guidance receptor 1
  ENST ID: ENST00000618833
  CDS Start-End: 999-5819
aattgagctggagaggaggcagcgtgagagcagaaacttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagctccttcagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 178073 - DNA, 7483 bp, Homo sapiens
  Payload ID: 14930
  Gene Symbol: ROBO1
  Gene Name: roundabout guidance receptor 1
  ENST ID: ENST00000618846
  CDS Start-End: 1239-5816
aattgagctggagaggaggcagcgtgagagcagaaacttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaatgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctggtaatcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctc

SEQ ID NO: 178074 - DNA, 5437 bp, Homo sapiens
  Payload ID: 14931
  Gene Symbol: ROBO2
  Gene Name: roundabout guidance receptor 2
  ENST ID: ENST00000332191
  CDS Start-End: 57-4376
ttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttc

SEQ ID NO: 178075 - DNA, 8946 bp, Homo sapiens
  Payload ID: 14931
  Gene Symbol: ROBO2
  Gene Name: roundabout guidance receptor 2
  Uniprot ID: Q9HCK4
  ENST ID: ENST00000461745
  CDS Start-End: 901-5037
ggcgaggggcctcagcgcgcctggcgctggactgagcgctccctttctccgccgcgcccgggctgggctctcacgcccgtctctgctcgcgcccgcagccgcctggtgcactatcctcagaggcggcaccgcgggggtgtctgcagcctcggcctccgcccggcccctccctccctccctccctccctcgctccttccctgcctccctcaccacgtaggagttcggattctccacccgaatcgtcctgatttcccttctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 178076 - DNA, 5919 bp, Homo sapiens
  Payload ID: 14931
  Gene Symbol: ROBO2
  Gene Name: roundabout guidance receptor 2
  Uniprot ID: Q9HCK4
  ENST ID: ENST00000487694
  CDS Start-End: 280-4464
cgctggaggagggaggcggaaggacagcgctgcgccaccacccggaggagggagcgcggtagctgcaggcaggggagggagaggaaagaaaaggaaggacggctcccagacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacatt

SEQ ID NO: 178077 - DNA, 805 bp, Homo sapiens
  Payload ID: 14931
  Gene Symbol: ROBO2
  Gene Name: roundabout guidance receptor 2
  ENST ID: ENST00000490534
  CDS Start-End: 1-595
cagtaacaccagtgcagccctgagtcaaagtcagaggcctcggcccactaaaaaacacaagggagggcggatggaccaacaaccagcattgcctcatcgaagggaaggaatgacagatgatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttg

SEQ ID NO: 178078 - DNA, 5393 bp, Homo sapiens
  Payload ID: 14931
  Gene Symbol: ROBO2
  Gene Name: roundabout guidance receptor 2
  ENST ID: ENST00000473767
  CDS Start-End: 57-1751
ttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagatatgtagtttagaaggctcagttataatattgcatgtggaaatgatgcaaaagaaaacacaccttgtaacaggaaaatgtattggcataatttactctgtagtccatttattctttctacaggttaattcttttcaagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttc

SEQ ID NO: 178079 - DNA, 642 bp, Homo sapiens
  Payload ID: 14931
  Gene Symbol: ROBO2
  Gene Name: roundabout guidance receptor 2
  ENST ID: ENST00000471893
  CDS Start-End: 1-642
ttcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatgccttactttacattcctgactaccgattggctgagggattgtctaatagaatgccacacaaccagtctcaggatttcagcaccaccagctctcacaacagctcagaaaggagtggcagtctctcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgg

SEQ ID NO: 178080 - DNA, 1431 bp, Homo sapiens
  Payload ID: 14931
  Gene Symbol: ROBO2
  Gene Name: roundabout guidance receptor 2
  ENST ID: ENST00000490991
  CDS Start-End: 1-1028
acaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaa

SEQ ID NO: 178081 - DNA, 686 bp, Homo sapiens
  Payload ID: 14931
  Gene Symbol: ROBO2
  Gene Name: roundabout guidance receptor 2
  ENST ID: ENST00000475334
  CDS Start-End: 1-625
ggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacagagtaaatgagaggagacatacaaagctgctctgaaggaccatcaggtccggactcatggaagtgat

SEQ ID NO: 178082 - DNA, 3382 bp, Homo sapiens
  Payload ID: 14931
  Gene Symbol: ROBO2
  Gene Name: roundabout guidance receptor 2
  ENST ID: ENST00000602589
  CDS Start-End: 173-3382
agacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcgccctgttgctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtgga

SEQ ID NO: 178083 - DNA, 7662 bp, Homo sapiens
  Payload ID: 14931
  Gene Symbol: ROBO2
  Gene Name: roundabout guidance receptor 2
  ENST ID: ENST00000614793
  CDS Start-End: 1-3753
tcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 178084 - DNA, 4569 bp, Homo sapiens
  Payload ID: 14932
  Gene Symbol: ROBO3
  Gene Name: roundabout guidance receptor 3
  Uniprot ID: Q96MS0
  ENST ID: ENST00000397801
  CDS Start-End: 193-4353
ggagagaaggacgagggaaggaggagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacgggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 178085 - DNA, 1520 bp, Homo sapiens
  Payload ID: 14932
  Gene Symbol: ROBO3
  Gene Name: roundabout guidance receptor 3
  ENST ID: ENST00000543966
  CDS Start-End: 858-1307
ggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatc

SEQ ID NO: 178086 - DNA, 4551 bp, Homo sapiens
  Payload ID: 14932
  Gene Symbol: ROBO3
  Gene Name: roundabout guidance receptor 3
  ENST ID: ENST00000538940
  CDS Start-End: 241-4335
tcgccaagcgtggttcagccactcccgcttaaacttggcaggagaggagacggaggtctctaggtggtccagaaagccggcctagaagtttgtgtcccgatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 178087 - DNA, 4710 bp, Homo sapiens
  Payload ID: 14933
  Gene Symbol: ROBO4
  Gene Name: roundabout guidance receptor 4
  Uniprot ID: Q8WZ75
  ENST ID: ENST00000306534
  CDS Start-End: 487-3510
acttcactcagcctccccagcctgcagccccactgccctctgtcttcagcttcttgctgtgtcctgagactcctggggttttcactcttctctagcaggtgtcaaagggataaggattgggatccagggataagatttaaatagaggattaaggctctgatcggagttttggttagtgtaaggataccctgtaagaaatccccgagtagatcatgagataaagcttagcgctgaagttagggtcgggggttatagctaaatggtcgaggtcagagagtttctcgcctctggtctcctcccagttctccaaggcactgagggccaggcaggaagcatcggtttcctcaaagccgcttccctcctggggcagagtctcggtcacaaacaaccaccaccggcccaccccgcccctccttccctcttcactgtgagctcagagcagcaggacaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 178088 - DNA, 3071 bp, Homo sapiens
  Payload ID: 14933
  Gene Symbol: ROBO4
  Gene Name: roundabout guidance receptor 4
  ENST ID: ENST00000533054
  CDS Start-End: 303-2891
cttccctcttcactgtgagctcagagcagcaggacaaagtgctcgggacaaggacatagggctgagagtagccatgggctctggaggagacagcctcctggggggcaggggttccctgcctctgctgctcctgctcatcatggccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagc

SEQ ID NO: 178089 - DNA, 670 bp, Homo sapiens
  Payload ID: 14934
  Gene Symbol:
  Gene Name: RP11-1012A1.4
  ENST ID: ENST00000553306
  CDS Start-End: 1-356
caaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcaggggagattagtaatttttaggtattaaagatacactcaaccaaagggacagaatgggaaaggctgaaaggggaatgaataacgttctcatcgttcaagtcattgccggtgccacacccagagaaaaacaagcaccacaccagacagcctctcagcaagccgaaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatc

SEQ ID NO: 178090 - DNA, 274 bp, Homo sapiens
  Payload ID: 14934
  Gene Symbol:
  Gene Name: RP11-1012A1.4
  ENST ID: ENST00000557564
  CDS Start-End: 1-274
caaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaagaagaaaagaagaaattgatcagggattttgatgaaaagcaacaggaagcaaatgaaacgctggcagagatggaggaggagctacgttatgcacccctgtctttccgaaaccccatgat

SEQ ID NO: 178091 - DNA, 378 bp, Homo sapiens
  Payload ID: 14935
  Gene Symbol:
  Gene Name: RP11-101E3.5
  ENST ID: ENST00000482796
  CDS Start-End: 57-378
acaagagcaagcagaacctctctgaccgctcgcgccaggcctacactttccacctcatggaggcctctggcaccacctggagcccggagaactggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcggg

SEQ ID NO: 178092 - DNA, 498 bp, Homo sapiens
  Payload ID: 14936
  Gene Symbol:
  Gene Name: RP11-1021N1.1
  ENST ID: ENST00000568766
  CDS Start-End: 145-498
aatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgatcagctggacatcatctccatggcggagacaaccatgatgcca

SEQ ID NO: 178093 - DNA, 476 bp, Homo sapiens
  Payload ID: 14936
  Gene Symbol:
  Gene Name: RP11-1021N1.1
  ENST ID: ENST00000567442
  CDS Start-End: 1-293
ccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgggtctcactctattccccaggctgaagtgcagtgatgtgatcacagctcattgcagcctcgacctcctgggctcaagcgatcctcccacctctgcctctggagtagctgggactacaggtatgagcattctccaaggaaaggatgacatatttttggacctgaaacagaaattctggaatacctatctgatcagctggacatcatctccatggcggag

SEQ ID NO: 178094 - DNA, 652 bp, Homo sapiens
  Payload ID: 14936
  Gene Symbol:
  Gene Name: RP11-1021N1.1
  ENST ID: ENST00000568222
  CDS Start-End: 1-362
ccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggag

SEQ ID NO: 178095 - DNA, 652 bp, Homo sapiens; identical to SEQ ID NO: 178094
  Payload ID: 14936
  Gene Symbol:
  Gene Name: RP11-1021N1.1
  ENST ID: ENST00000634007
  CDS Start-End: 1-362

SEQ ID NO: 178096 - DNA, 476 bp, Homo sapiens; identical to SEQ ID NO: 178093
  Payload ID: 14936
  Gene Symbol:
  Gene Name: RP11-1021N1.1
  ENST ID: ENST00000633358
  CDS Start-End: 1-293

SEQ ID NO: 178097 - DNA, 498 bp, Homo sapiens; identical to SEQ ID NO: 178092
  Payload ID: 14936
  Gene Symbol:
  Gene Name: RP11-1021N1.1
  ENST ID: ENST00000633491
  CDS Start-End: 145-498

SEQ ID NO: 178098 - DNA, 764 bp, Homo sapiens
  Payload ID: 14937
  Gene Symbol:
  Gene Name: RP11-1035H13.3
  ENST ID: ENST00000567078
  CDS Start-End: 54-764
gaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaag

SEQ ID NO: 178099 - DNA, 4374 bp, Homo sapiens
  Payload ID: 14938
  Gene Symbol:
  Gene Name: RP11-106M3.2
  ENST ID: ENST00000379915
  CDS Start-End: 10-693
cagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggctgcaagggagacgaatgtgtctgaggctcaggggtaagaaagtggttaaagacaccgaagacagagatgtgtgatggggcggggtgggattggctccgagggactggctcgatagtgggaatagagaagaggaatccccatccacccccgcaggaaacgcaccagcgtttggaggtgtgtgtgcctgcgtgtgcctgcgtttgcctgtgtgtgcctgtgtgtgcggtggggattagccccgactccggcagacaccatcacgcatgacgaagctgcttcccctcacgcggcccaaggcgcacacgcgcgatccacggccacgcccgcacacactcgacacacacagggcattcgagggtccggttgccatggcgagcaggagcgcgtgagcccagccgccccccccgcccccggcgagcccagtcaactcccactctgattggcggctgcttcctcattatgcaaatcatttgcgtagactcggcggccagctgcctgacgtcaccaagcacgggggctggggctcggggctcggctctgggagagctcgggcgggagcccagagagagccgcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaagggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 178100 - DNA, 1902 bp, Homo sapiens
  Payload ID: 14939
  Gene Symbol:
  Gene Name: RP11-106M3.5
  ENST ID: ENST00000569547
  CDS Start-End: 73-1518
accggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttca

SEQ ID NO: 178101 - DNA, 5183 bp, Homo sapiens
  Payload ID: 14940
  Gene Symbol:
  Gene Name: RP11-1070B7.1
  ENST ID: ENST00000611424
  CDS Start-End: 4-5106
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccatacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacccgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgccttattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaatgaaaa

SEQ ID NO: 178102 - DNA, 3856 bp, Homo sapiens
  Payload ID: 14940
  Gene Symbol:
  Gene Name: RP11-1070B7.1
  ENST ID: ENST00000626350
  CDS Start-End: 1571-3787
ttgaaaactataatgcctttcaaatatggcttattgcttggatctcaatatctcccacgtatcttgggtggaatattttgctgaagatctttctgtcaatcatttacaatcatgtgctgcaaaatgaagtttgggtcaacagtagaccacatatatgatggtggttccgtaagcgtataatggagctatccctatataggtataccatttttatcttttttttttttttttttttgagatggagtctcactctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtgggaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcagaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccatacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacccgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgccttattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatg

SEQ ID NO: 178103 - DNA, 5018 bp, Homo sapiens
  Payload ID: 14940
  Gene Symbol:
  Gene Name: RP11-1070B7.1
  ENST ID: ENST00000628214
  CDS Start-End: 36-4943
cttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccatacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacccgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgccttattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaatgaatgaa

SEQ ID NO: 178104 - DNA, 1605 bp, Homo sapiens
  Payload ID: 14941
  Gene Symbol:
  Gene Name: RP11-108K14.8
  ENST ID: ENST00000468317
  CDS Start-End: 256-1275
cctccccatatgtgatccaggagttgaggccagatcactattcagtgtttacaccccttgttttctctaaaagctgttcacacctgagctgcggggtgcagtggcttcctttcccacccattggtggatgcgtgtgagccgtcttcccacccgttggtggatgcgtgtgagccgttttcccgcccgttggtggatgcgtgtgagccgttttcccgcccgttggtggatgcgtgtgagccgttttcctggctgttgatggatacatctccagatcctgtttgcgggggaagccacacatcgcacgttttactccacgacgcacggggctctgctgtcgggatggagggaggccgaccgcctcctcagtctgtgggccccgcagggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagtt

SEQ ID NO: 178105 - DNA, 817 bp, Homo sapiens
  Payload ID: 14942
  Gene Symbol:
  Gene Name: RP11-108O10.8
  ENST ID: ENST00000542429
  CDS Start-End: 1-641
gtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaagg

SEQ ID NO: 178106 - DNA, 432 bp, Homo sapiens
  Payload ID: 14942
  Gene Symbol:
  Gene Name: RP11-108O10.8
  ENST ID: ENST00000526587
  CDS Start-End: 1-432
ttctcaacccagaatcttcaggatcaaactgggtaaccagtggttttcctttccagaaccagaagcacttgtaggaaagttgaacaggttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaa

SEQ ID NO: 178107 - DNA, 2939 bp, Homo sapiens
  Payload ID: 14942
  Gene Symbol:
  Gene Name: RP11-108O10.8
  ENST ID: ENST00000622211
  CDS Start-End: 294-2828
gcttgtgacctcatgcaggtgtgatgaagtcgctcaaggccatgcttgggctaaagacactttgatcttcccgagggggtgaaagggcgaggtgacaggaaagtgcgcgtcttgcttttgcactcatagttatcatccaccggggagtcggtacaccggctcgtctagacaaccaggcgccatgggtgcgtcatcaactagtgacgggagaagacggggcggagagagatccgtgaaggaagtgacgtaaaacgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcatcttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatg

SEQ ID NO: 178108 - DNA, 348 bp, Homo sapiens
  Payload ID: 14943
  Gene Symbol:
  Gene Name: RP11-1099M24.7
  ENST ID: ENST00000573621
  CDS Start-End: 1-17
ccgcccgggctggctgaagcaacctacctcaagtctcaggagaattcatgtctgcctggggcccttccgaacctgtgccaactaagggcccccactgaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggaca

SEQ ID NO: 178109 - DNA, 1947 bp, Homo sapiens
  Payload ID: 14944
  Gene Symbol:
  Gene Name: RP11-111H13.1
  ENST ID: ENST00000424491
  CDS Start-End: 637-1212
gagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaagcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatgacggagtcttgctctgtcacccaggatggagtgtaatgccacggtttcagcttactgcaatctctctgcctcctggcttcaagcatttctcctgcctcagcctcccgagtagctgggaccacagaaaccacaacaaaggtgcttgcccatggctcctcgcttccctctgcctcatgactgatgccaattattccccttgtggccccctgtggtgtgacatgtactccctctccggggatccgaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatgttacctgtaattaagaatgtcagaagaaccgagcctccattctaaagtttctgtggtgaagtcatctgtatttcctaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctagg

SEQ ID NO: 178110 - DNA, 2430 bp, Homo sapiens
  Payload ID: 14945
  Gene Symbol:
  Gene Name: RP11-111K18.1
  ENST ID: ENST00000442788
  CDS Start-End: 17-721
ggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattcaa

SEQ ID NO: 178111 - DNA, 1231 bp, Homo sapiens
  Payload ID: 14945
  Gene Symbol:
  Gene Name: RP11-111K18.1
  ENST ID: ENST00000433579
  CDS Start-End: 14-160
tcttcgggtaaagatggcggagcgcgggtacagcttttcgctgactacattcagcccgtctggtaaacttgtccagattgaatatgctttggctgctgtagctggaggagccccgtccgtgggaattaaagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagccctaatctttctgggtgactctggacactctactacagtaatatgaatatggcagcccctcggaagccatgcaatcatttcttctcttcagaaggacagcacactttctttggagggcccaggacaatgcagtggaaagtgctttggcttggaggcagaagtcccagaggcagtacttctcagctgtcacctctgacaagcttctccagcgtttcttctgttaaaatgagcccccaaaatgcctacgacccggttgcgatcgagtggccgacgcccccagtgggagtgaggcccagcacgcgagctcggtccctcttcctggagccaggtgggtgcgcgccttcaggctcacccggcggcgcaagcgggagaagccaggtgccctcaataaacatggccgccacgccagcgtcaacccggctcgggaggccgcgctgccgcttgggaatcgcaggtttggcgtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagct

SEQ ID NO: 178112 - DNA, 5363 bp, Homo sapiens
  Payload ID: 14946
  Gene Symbol:
  Gene Name: RP11-111M22.2
  Uniprot ID: Q3ZCU0
  ENST ID: ENST00000321844
  CDS Start-End: 505-1269
gcgcgcctgtctcccgggacgctagagcaggcggttcctgggctgctccggtaggtttggcgtgcgcgggtttctgcagatctagggcgagcttgcacgttacatcaccgatgcatctcttcttgcttgcttaatttgccaccacttaggcctttcttgcagaattcgccatatactccttaagggccgcggaatcggagcgaccttggtgactggcaaactctcggcagatgtgcgtgcactggtttgatgcagacgtggttgtaggcgatttaatttttcccagctttgcagcgactgttggcttcccagaacggatctccccagcctcgactggaagctgagggacaaaaattcataaaagcaattactctttcccggcgaggcttctagaagagcaagaagagcgatatgattacacctgcagccctataaagattgatctgtccgtctttcccttacagtcgtggcctgttaaacgttcctgtgttgttcagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaaggagacggaacctcactatgttgcccaggctggtctcgaactccttgtctcaagggatcctcccaccttggcctcccaaagctctgggattatcagcatgagccaccatgccaagccaaaaccaggagttcaatggtgtaaattccagtctgagtccacaggccgaagagcgaggagtgctgatgtacaagggcaggagaagatggatgtcacagctcaagaagcgagaacaaatttgcccttctatctttttgttctattcaggtcctcaatgaattggatgatgtccatgcacattagggagggctgcctcttcattactcggtctaccaattcaaatgctaatctcttccggaaacatccccacagacacacccagaaataatgttttcccatctatctcagtaccccatgatccagtcaagtgaacatataaaattggctgtcacatctccattttgtttatttatttacttatttattttagactagttaagttcagtagtgagaaagagggaaggaatagaacgaggagttcaatctgtgactgacagtgaacaattgattgagataactcactacctttggaccagccatctccattttataaataagaaaactgaagctcagaaaggttgtctaaactgccaaagccatagaactttaagtgcggaaataggttttgtgttcaatctgcttctctataaaatcccatacaggacatccaggcatctaaaaggtagctcagtatctctgccttctctccattgttagccttgatggacaatttttgctggagcaaatattctgaaaaagattcctcctgtttcctatgggagtagacagcaagcaggtgaagccgggctctcttgagcctgggaccccccggtaggagcatttggctggaaagatgtggaagtcaataagcatttcctccaccacccagaagcatctccaagctcaggcaggaggtgggcagtgaaggggaataccaagcatcctgcacatcaggtagaaggaggaagcccaggccatggcaggacttacctgttgagtcctgctgggtttgggcaatgtctcagcagagactggcatactctcaggcttttcacttccttccttagactgggggcgcctcttgccctgtgcatcttgcacaaagcctggtcctgagtaggtgccctgcaaaggtgcaggggatcaatgggggtgactgagtctaactgaagaaaaagaaggcatttcaagtctctataggttggggactttaatgagtgtaaatagctaccctttattgagcattgtttatgtgtggacactttttatgcatgtatattggaatatttttagctgtaagtaatgataactaacagtgacttaaataagtagttattttctggcataataagaattccaaaggtgctcctttggtctttccatcttggttacaagatggctgtgacaccctgccctcacctccaagttcaaggcaggcaggggttgggaggtgcggacagttcagactcagcagtcctgtttcatcaggaaagcaaaagctctcccagtaactcccagcagagttctactaaatctcattggcccaagggagctgcagtggtaggtaacaaggagcaaatggcttttgggtagccagtcaacagggtctgccatgtgcatagaaagcacagtatgtatttggcatggagtcggtactcaataagcattagctatttggcgtgcctgtgtgtgtttgtgtgtctgcgtgtggttatatgtatattttccattttcccaaacagtccttggaagtagcatcctcctttactaatgggacctaacacacagctggcaaaaggcacagttagagccacacatcagactcatttctttctgactgaagtctgagggctctttccattgccatgctatgttccaccctccccttcaactgcccctctaaagtcttgtcttggagtcacatgaggtccaagtgggcttgatgaagaaagaatagggaaggagatcagatcagtactgttgtccaggctggagcgcagttgattgtagctcactgcagcctccaactccatggctcaagtgatcctcctgcctcagccttccaagtagctaggacaacaggtgcgtgctaccatgcatggctaattaattaaaagaattttttttggtagagacagggtctcactatgttgcccaggctggtcttgaactcctgggctccagtgatcctcccccttcagcctcccaaagtgctagaattacaggcattagccaccatgcctggcctggagatcagttcttttttacttttttttgagacaggctctccctatgtcaccgaggctacagtgcagtggttcaatcgcagctcactgtagcctctatctcctgggctcaagtgatcctcccacctcagcctcctgagtagctgggactagaggcatgtatcaccatgcccagctaatttttgcattttttgtagagtcagggtttcaccctgttgcccactctggtctcaaactcctgggctcaaccaatctgcccacctaggcctcccaaaatgctgggactataggtgtgagccactgcacctggcctggagctcagttctgaaataagttgacacctgtccctggggctatccacagagtaacgatgaagtcatgagaggaggttcaataactgtgtgctagagtcatacctccacctgagtgcagccactttggaatggtcaggctagaaggttcagcctttattctgatgatgccactactgcccagaactcctctgggactctttgcaagttgcaaaagacctcaatctcattactgtaatattgcacctcatttctgaccccaaacccagctgcagcttctcatctcacgaatttcaagtgacttttgactattgccaaaaatcaaaaatcattccctgaaaacagaatctattgtaatttagatgcaaaagaatgtgttgtctgctttgcagccaattttcaaataaaaaagaaatgtttaaagcagtggaagcactgtttaaataaatatgccgggccaggcgtggtggctcacgcctgtaatcccagcactttaggaggccaaggcgggtcgatcacgaagtcaggagatcgagaccaacctggctaacacagtgaaaccccgtctctaccaaaaatacaaaaaattagctgggagtggtggcgggtgcctgtagtcccagctatttgggaggctgaggcaggagaatggcaagaacctgggaggcggagcttgcagtgagccaaggtcacaccactgcactccagcctgggctacagagcgagactctgtctcaaaaaataaataaaataaaataaaataaataaataaataaatatgccctcccaggttgacatcttggaagaggataactctaagtttggttgtataatttctgctgtgtttaagaaaaattacttaacttgtgagacattatgaaaaggatgctggacttggtaaagatacaaatgggcttataatgttggtcaggtgagacatgttgcattggtgaaattataaattgatattgttttctcagagcaatttcgcaatgagcatcacgaagctttaaagagtttaaaccacaccggtcacagtggttcacgcctgtaatcccaatactttgggaggccgaggtgggcagatcacaagtcaggagctagagaccagcctggtcaacatggtgaaaccccttctctactaaaaatacaaaaattagctgggtgtggtggtgcatgcctgtaatcccagctactcgggaggctgaggcaggagcatcgcttgaacctgggaggtggaggttgcagtgagctgagatcgcaccactgcactccagcctgggcggcagagcaagactccctctcaaaaaaaaaaaaaaaaaaaaaaaaaaagaatttaagccagttgacctaggaatcttctaggacgatttcttaggaatctttcttaggaaaacagtcagagatgcagacaaagatttatgtaacagccattcattgcagacttatttgtaaaagtagtaaaaagaaggaaataacccaaatgtcccacaatggagaaattgttaagaaaattacagcatactcattaagtgaaataatgcagctatttaagatgatgtttttaaagaactgtcaatgatgtttgaagatgttcacaataagataggtgataaaacagactataaaaccacatgcattatatagtcccatttttactttctgtatgctaaaacaaacccctcaagatagatccaaaacattaccagtggtttgatctgggtgatgaaattataagtgattttaaacttgcttcattatgcttttatatatataatttttcttattataacaataaatattacttttgtagttagaaaatatgtataatgaacattaaaattacttgttaagaaagaaagaaa

SEQ ID NO: 178113 - DNA, 700 bp, Homo sapiens
  Payload ID: 14946
  Gene Symbol:
  Gene Name: RP11-111M22.2
  ENST ID: ENST00000529331
  CDS Start-End: 25-588
gttcctgtgttgttcagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaagggtgagcctaaaccacgaaaacttgactttcggtccgatctttcaaaggaaactaggaaaaatagctcatgtttgaggaaaaagagacggaacctcactatgttgcccaggctggtctcgaactccttgtctcaagggatcctcccaccttggcctcccaaagctctgggattatcagcatgagccaccatgccaagccaaaaccaggagttcaatggtgtaaattccagtctgagtccacaggccgaagagcgaggagtgctgatgtacaagggcaggagaagatggatgtcac

SEQ ID NO: 178114 - DNA, 2462 bp, Homo sapiens
  Payload ID: 14946
  Gene Symbol:
  Gene Name: RP11-111M22.2
  ENST ID: ENST00000530460
  CDS Start-End: 514-1146
attgcgcatgcgcgcctgtctcccgggacgctagagcaggcggttcctgggctgctccggtaggtttggcgtgcgcgggtttctgcagatctagggcgagcttgcacgttacatcaccgatgcatctcttcttgcttgcttaatttgccaccacttaggcctttcttgcagaattcgccatatactccttaagggccgcggaatcggagcgaccttggtgactggcaaactctcggcagatgtgcgtgcactggtttgatgcagacgtggttgtaggcgatttaatttttcccagctttgcagcgactgttggcttcccagaacggatctccccagcctcgactggaagctgagggacaaaaattcataaaagcaattactctttcccggcgaggcttctagaagagcaagaagagcgatatgattacacctgcagccctataaagattgatctgtccgtctttcccttacagtcgtggcctgttaaacgttcctgtgttgttcagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaagggtgagcctaaaccacgaaaacttgactttcggtccgatctttcaaaggaaactaggaaaaatagctcatgtttgaggaaaaaggtaacaggttctgaaacatggagttatctccagggtgaagctggtggggaaatgcccctgccggtatcccatcccagagtccactactctgccagtcagcttctgcaggcgtcatcttcaacaagccttccccccagggtagctgagaattggttcaccccatggtgagaggaatgtgagttagctgaaccagaactaggatgctgcctcactgttaggcaccttctttggctgctcacgtatttttcagtcttcaccactcctccctatgtgccatggccctcctcattactctttgctggactcttggaccattttccttgctgttctccataactttgaaaaacttttggctgttcccttctggtatttgcttgttcttgatttcttttgctcaacaagtttggatttcttctctgcccagaccttagcttgttgtggctgtcctgttcctttgttctcaaccttctgcctcagaggatcatgccagtgagaagagaggaacaggatctcctggaatctgtatctctgtgcccagggaagcatgcttttctgggaggaccccaaaagaaggcttacagtttcagcctgctttgcagtcagggcctgaggtatggtacagaaggtagtagcatgctggtattactgaacagtgctgggcctaggggctgatctggcccagatgactcagtaggcacccttaggaatcaggggttggccaccaatactgatcttctcacaggcctacacctcacagaagagctgggtttgtttcattctagtcctatgctttggacctccactcatttgggtatcacccctgttggaagaggaggatctggtgctagaaaatataaacccggggacccaggcaaggctgtgttgtgtggggaggaagaccaggtggctctctagtccctgaattaagggagcctgctgcctatgtgcggattcccacacagcagcctgtttttagtaactaatgcctatagttttgagaacttgctgtttttaggacactgctgggcattgacaatgtggaggttatgaacaagatctccaagggctgatgggcttcatggatgagatggttcttgaactggatccatgaggatgggtgagacagggctgtgaaattagggaaagcttccggggcaggtggaacagcatgaggcttccaacctgcatcagtagaaaatgacactggccaggtgtggtgaatcacgcctgtaatcccagcactttgggagactgaggtgggtggatcacaaggtcaagagatcgagaccatcctggccaacatggtgaaaccccgtctctactaaaaatacaaaaattagctgggcgtggtggtgcacacctgtagtcccaactactcaggaggctgaggcaggagaatctgttgaacccggaaggcagaggttgcagtgagtggagattgcgccactgtactccaacctggcgacagagctagactctgtccc

SEQ ID NO: 178115 - DNA, 451 bp, Homo sapiens
  Payload ID: 14947
  Gene Symbol:
  Gene Name: RP11-11N7.5
  ENST ID: ENST00000489705
  CDS Start-End: 1-131
caattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagcttttctgtccatgtgaatgtgctgtgtggaagagttaaagggcccaactaaatgttccagtgattccaatagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttat

SEQ ID NO: 178116 - DNA, 496 bp, Homo sapiens
  Payload ID: 14947
  Gene Symbol:
  Gene Name: RP11-11N7.5
  ENST ID: ENST00000475997
  CDS Start-End: 1-194
ctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggttctgtccatgtgaatgtgctgtgtggaagagttaaagggcccaactaaatgttccagtgattccaatagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgt

SEQ ID NO: 178117 - DNA, 462 bp, Homo sapiens; identical to SEQ ID NO: 103623
  Payload ID: 14948
  Gene Symbol:
  Gene Name: RP11-1212A22.4
  ENST ID: ENST00000327792
  CDS Start-End: 1-462

SEQ ID NO: 178118 - DNA, 1547 bp, Homo sapiens; identical to SEQ ID NO: 116860
  Payload ID: 14948
  Gene Symbol:
  Gene Name: RP11-1212A22.4
  ENST ID: ENST00000427999
  CDS Start-End: 412-1521

SEQ ID NO: 178119 - DNA, 699 bp, Homo sapiens; identical to SEQ ID NO: 103627
  Payload ID: 14948
  Gene Symbol:
  Gene Name: RP11-1212A22.4
  ENST ID: ENST00000531453
  CDS Start-End: 1-699

SEQ ID NO: 178120 - DNA, 671 bp, Homo sapiens
  Payload ID: 14948
  Gene Symbol:
  Gene Name: RP11-1212A22.4
  ENST ID: ENST00000528301
  CDS Start-End: 1-671
atcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagagg

SEQ ID NO: 178121 - DNA, 1522 bp, Homo sapiens; identical to SEQ ID NO: 116861
  Payload ID: 14948
  Gene Symbol:
  Gene Name: RP11-1212A22.4
  ENST ID: ENST00000545114
  CDS Start-End: 308-1006

SEQ ID NO: 178122 - DNA, 240 bp, Homo sapiens; identical to SEQ ID NO: 125944
  Payload ID: 14949
  Gene Symbol:
  Gene Name: RP11-1236K1.1
  ENST ID: ENST00000437818
  CDS Start-End: 1-240

SEQ ID NO: 178123 - DNA, 2107 bp, Homo sapiens
  Payload ID: 14950
  Gene Symbol:
  Gene Name: RP11-123K3.4
  ENST ID: ENST00000548184
  CDS Start-End: 1-195
tattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgccctgtcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtccc

SEQ ID NO: 178124 - DNA, 545 bp, Homo sapiens
  Payload ID: 14951
  Gene Symbol:
  Gene Name: RP11-125O5.2
  ENST ID: ENST00000543498
  CDS Start-End: 1-284
agtatggttggtctgcatctaagactaactttttgttggtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttggggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagttacaggtattctaaagaaactaatatcaattcatcagaaaattcaacatcgaccttatccacttgtttaattaatcaaattttatcactcaatagagcatcacctgagatagtgggaaa

SEQ ID NO: 178125 - DNA, 581 bp, Homo sapiens
  Payload ID: 14951
  Gene Symbol:
  Gene Name: RP11-125O5.2
  ENST ID: ENST00000592513
  CDS Start-End: 1-190
gattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggttactgaagagacattttcaccagtatcttctaggtatgagacactattcttggaactgagtatacagcagtgaacaaataaaacaaaaacctatccttgttcttctggagattcctctgcagtgtaacttcatggtttttgaggcaaaggaaggctggcagtaaacaaaatatagcaatgacataataaggtggttaatcatcactggacttgttttcaaaaagccaactactttaagaggaataaagggtggacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcag

SEQ ID NO: 178126 - DNA, 600 bp, Homo sapiens
  Payload ID: 14951
  Gene Symbol:
  Gene Name: RP11-125O5.2
  ENST ID: ENST00000590779
  CDS Start-End: 1-236
tctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggtatcttctaggtatgagacactattcttggaactgagtatacagcagtgaacaaataaaacaaaaacctatccttgttcttctggagattcctctgcagtgtaacttcatggtttttgaggcaaaggaaggctggcagtaaacaaaatatagcaatgacataataaggtggttaatcatcactggacttgttttcaaaaagccaactactttaagaggaataaagggtggacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcag

SEQ ID NO: 178127 - DNA, 519 bp, Homo sapiens
  Payload ID: 14951
  Gene Symbol:
  Gene Name: RP11-125O5.2
  ENST ID: ENST00000593147
  CDS Start-End: 1-291
gctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaagtatcttctaggtatgagacactattcttggaactgagtatacagcagtgaacaaataaaacaaaaacctatccttgttcttctggagattcctctgcagtgtaacttcatggtttttgaggcaaaggaaggctggcagtaaacaaaatatagcaatgacataataaggtggttaatcatcactggacttgttttcaaaaagccaactactttaagaggaataaagggtggacttgttgcagttgctgtaggattctaaatccag

SEQ ID NO: 178128 - DNA, 594 bp, Homo sapiens
  Payload ID: 14951
  Gene Symbol:
  Gene Name: RP11-125O5.2
  ENST ID: ENST00000585342
  CDS Start-End: 1-270
ttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttggggtatgagacactattcttggaactgagtatacagcagtgaacaaataaaacaaaaacctatccttgttcttctggagattcctctgcagtgtaacttcatggtttttgaggcaaaggaaggctggcagtaaacaaaatatagcaatgacataataaggtggttaatcatcactggacttgttttcaaaaagccaactactttaagaggaataaagggtggacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcag

SEQ ID NO: 178129 - DNA, 3422 bp, Homo sapiens
  Payload ID: 14952
  Gene Symbol:
  Gene Name: RP11-12J10.3
  ENST ID: ENST00000494792
  CDS Start-End: 1-605
agcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacaggcagcacagtgcagacttctgctgcgtgagtgagttgcgggggccccagaagcacgaagcccagcccggcgtggcccactgtctcccgtgcatggccctctgcttacccggactcaggagaagggcgtgtttgcggcctggaggacaggcgtggagaggtttgcttgatttccataactcaacacttgcccacacaatctgcccatggaagtctggcctagaatgcttgttagggccagagcagcccctctgggaatgaggctctgtagcccccgcttttcttttggtttttgcttttagcaagattttttttttttaagtctatgagcactgaactcaagaaacaaacatgtgaagtggggctgctggggggaggtgagccccttgtcctcactgccatccctgcagccctgccttacccaaggcctagggactcactgattcgaggctggatgcattgacttccccagcacaccctcccctcacccctgcctccgtatctgacagatgactggtgggccaggggctggcggggggcttctacccagcgcagtgcccccacccttgtgccccacctgagggtagggcacagagtggccctggaattacctctggcccttaccagccccttgctgcccccaatccctagatgaggtccctggctggatggatagctccgttctgcccccacgtggggcctggccccaggcctcacccccagtgcagtgcccaggccaggcacaggtgcttctgacatggggcacacgtgtagtctccttacctgcacagcgatcataaccctgtgggcttacgagagagactcagccactctgtccagtgtgcagggaaagggctggaaggaagaaggccgaaaggaaaggccccagagagcacagtgctcagactcccgggtgacttctggtttctttttatatacttctgttaaatttcctgtaataacacatgctgcttttataatgttaaaaaaaccacgtagaatgtaggctgccccgtgtgttcacctcctaaaccaggacagttctgaggggcagctggaactgttgacacgcactctggcacgggaggcggacccaagagcacccaccccagaggggcaccacactcgcccgtcccgccctgtgtccccacctctgccctgaggtgaacacaggaggctttccacctgccagctgccagccaacctccccgagaggggcaggaaccgaccagcaggacagacccacccaggacagcggcaccaggtcaggcctcagcctttccgatcctctggagggctcaagccgaacggaaggagggaagaactgcagtcacctgggccggtggcgctcacatctgacgtggaggcctctgcttcacttggcccagttcccagccttgtcggcagtgaggacatggaccctcgctggcatccgtcctccgtctggcacaacgtgccgtgttctctctggttagggtttgggtgggacggagactgcgcccctgttcctggtccgcctaagtctctgccagtctgagtctcgtgggccttttctgcaggccctggggttgcggagcaggcagggggacgtcggtggctgggggacatcccgccacctgccaagtagctgcaatgggaagagatgcggttcccgtgacagccaggcctggatgttcaagtcatgtgagaccaccaaataccttgttgcactaagcc

SEQ ID NO: 178130 - DNA, 950 bp, Homo sapiens
  Payload ID: 14953
  Gene Symbol:
  Gene Name: RP11-136C24.3
  ENST ID: ENST00000443313
  CDS Start-End: 111-431
atcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtgagggtcaaaagggttgggtggaagttcatgggactgagacctgatggccttgctgcaaaccttgggaccttcaactgtggccctgagaagcccacagtccatcagacagaagttattggatcagaactttaggcggtggtggggagccctgggaaagctgagaggggatacagttggcagggcctaccccaatatccagagggcctcgtgcctgcagaatactagctgtattgctggggtgtgggaaggctagtccttcccttgttctgggtgagagagctaggccagagagtctacccctcccagctcactcttggcaggcagctctgcctt

SEQ ID NO: 178131 - DNA, 554 bp, Homo sapiens
  Payload ID: 14953
  Gene Symbol:
  Gene Name: RP11-136C24.3
  ENST ID: ENST00000446977
  CDS Start-End: 252-554
atcagttattttcgcctgccatagtgtacaccagtcttgaaacttgttactgtcgtagagcaaccaaaaatttgagaataccgaattgtattccctacccgtccccaggatgtcccattttggaaaatatggagccctgcgatctggattggctcataagaatgttaaatctaaaaagactgatcgtatccgtcatgcacctaatcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggcgtcttggctccggagaaagctgcg

SEQ ID NO: 178132 - DNA, 1221 bp, Homo sapiens
  Payload ID: 14954
  Gene Symbol:
  Gene Name: RP11-140L24.4
  ENST ID: ENST00000555531
  CDS Start-End: 46-540
attctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcg

SEQ ID NO: 178133 - DNA, 1620 bp, Homo sapiens; identical to SEQ ID NO: 116410
  Payload ID: 14955
  Gene Symbol:
  Gene Name: RP11-141O19.1
  ENST ID: ENST00000634648
  CDS Start-End: 1-819

SEQ ID NO: 178134 - DNA, 935 bp, Homo sapiens
  Payload ID: 14956
  Gene Symbol:
  Gene Name: RP11-145E5.5
  ENST ID: ENST00000404796
  CDS Start-End: 114-545
ctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcag

SEQ ID NO: 178135 - DNA, 3406 bp, Homo sapiens
  Payload ID: 14957
  Gene Symbol:
  Gene Name: RP11-146B14.1
  ENST ID: ENST00000536108
  CDS Start-End: 153-2594
atggctgacatgatggtctgtgacctgaaagttgttgaatagttggagtgttctgcattcatgtggaagaggctaaaggatgtttgatgaagcactatgggctgccctggaagaggactgaagaagcagctgcagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctagacacagcaacagtaacaacaacaacaataacaatgaaggctcactgtgaaaacatcaattcattaggaaagttacatcccctccgccactgtttcagatgctgtttctcattctccatgggagcagccagcatcgtgtttaggatggggatacaatagcctgagctcctgattgagtcagaccctggactttcccttttgtatctgtcattttcctctggatcctcacacctttgtgtttaatttttttaaatttcatttgttgacttcctatgtggggtaaaatgacttcctttgattaatgtactttctgtatcctagagtttccctttccctttgtgatttagtccaacgtgtcctactacagcctcaaaaattgtcattggaatcaaaagctttccaaggtgcatcaggttaatgatttggatgcatcctgaggttgtctcctgtagcatggaggcattataataggagtctcagaagttacaccatttttctacagcacatcacaggcccagaggcttgaatctaagagaatccactctatgtctgtcagcctgaatccttccttcttgctgcacaacaaagcaactgaacgtattttgagtttaggtgaaaactatcactcattcatcaaagttctatctgggtgatatatgctatcgaaacagatgtggacactgggctgacagatgttgagaacggacctgttgctgaagctcatgttatcacacatgctgtgggaagagaggtcattggcattcaagatgcaacacctacaatatggtgaattaaagatgccatttgcatgga

SEQ ID NO: 178136 - DNA, 2046 bp, Homo sapiens
  Payload ID: 14958
  Gene Symbol:
  Gene Name: RP11-14J7.7
  ENST ID: ENST00000335950
  CDS Start-End: 1-258
aaaaaggagcatgtcttcatccatgagaggcctcgaaaaatcaatggtatttgcatttctcccaagaaggttgcttgccaaaacctttcggccattttctgctttcagagtgagacaaagttcaaaatgacagtctgtcagctcattgaaggcacaagataccctgcctgcaggtaccactattcccccacagaggggtttgttcttgtcacttgtgatgacttgaggccagatagtttccttggctatgttaaataactcaagatcagctcccgagtctgagatctcttctctcaatggcattggagctggctgtgcctgaggcagacctggaccgtggacatggggcaatgccttgagcggaaggggaagccactgaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggcgtgcagattcttctctctctatctctctctctgtgtggggggagggtggggagggtgtaaaacaaactgaatttcatcctagctcagctataaagccaagaaacagaatccacctaactaggcagaattaaggaaacaaggactaaagccaatatggacaatgaaaagctaattgtactgccaatgatactattcagaaaaatagtgaatgagtgtgacatatattattatcactactctcttcaaagggtatgtgctcacacttgtgtgaattgatgtatgcacataacaaagagtctgcctgtccttcaggaaatgccagaggaaaaagattctttggctgagctgatgctctcagtgtcaatagctccagccctatgcaatctccattcttccacccccatctctatttcacaggttgctgtaaagagaagaaaattcttattgtaatctttattcaagccaagtcttgataccctggggctgtgggagaggaatggcaagccatggaagaatagaggagccagaaagatgggaatagaaagtctgtgctaagtaccaggcaggactggtcttcaaccttgatgtcttatgatactgtagttaattttgttcactaccagctatttatttgcaaacgttcgtggttcaacattctgcttaaagtatggacagttatcttcttcatcgatgtgtggccatatgtttctattcctctccttaaatcctccctccatcctgagaccactctttcttaatgttctaattttaactaaatgcatgtaaatgtatgtaaa

SEQ ID NO: 178137 - DNA, 578 bp, Homo sapiens
  Payload ID: 14958
  Gene Symbol:
  Gene Name: RP11-14J7.7
  ENST ID: ENST00000555283
  CDS Start-End: 291-578
agctttcgccggccgcgcgcacggcggtcggtacctgttaaggacgagatgccttccgaccaccggataactcgggacggtccctgatttgcctgctccctgtccaacagcatcttcggctcactcggaagtgaaaacatgcaatttcatgttataacatgcaatttcatgtcataaattattcccactgacgcctgaacatttttcctaaaagggatctgcagtcacaaggcgccgccttccggaatttagcagtcaaagccaaagatgcgaagtcactcttacctctgatgataataatggtgataattttcttggtgcttctgttctgggaaaatgaggtgaatgatgaagcagtgatgtcaactttagaacacttgcatgtggactaccctcagaatgacgttcccgttcctgcaagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaa

SEQ ID NO: 178138 - DNA, 880 bp, Homo sapiens
  Payload ID: 14959
  Gene Symbol:
  Gene Name: RP11-152F13.10
  ENST ID: ENST00000562833
  CDS Start-End: 1-880
tcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcagggccgcgttcgcaccaaaaccgtgaagaaggcggcccgggtcatcatagaaaagtactacacgcgcctgggcaacgacttccacacgaacaagcgcgtgtg

SEQ ID NO: 178139 - DNA, 880 bp, Homo sapiens; identical to SEQ ID NO: 178138
  Payload ID: 14959
  Gene Symbol:
  Gene Name: RP11-152F13.10
  ENST ID: ENST00000633171
  CDS Start-End: 1-880

SEQ ID NO: 178140 - DNA, 889 bp, Homo sapiens
  Payload ID: 14960
  Gene Symbol:
  Gene Name: RP11-156P1.2
  ENST ID: ENST00000571841
  CDS Start-End: 61-759
gctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgatagagacaaggtctcaccatgttgcccagaatggacccgaactcctgagctcaagagatcctcctgcatcagcctcccgaagtgctgggattatagaattctcagagaaaataacttgactgaattacacaaggattcatttgaaggcctgctatccctccagtatttagatttatcctgcaataaaatacagtctattgaaagacatacatttgaaccactaccatttttgaagtttatgatcttacc

SEQ ID NO: 178141 - DNA, 711 bp, Homo sapiens
  Payload ID: 14961
  Gene Symbol:
  Gene Name: RP11-159D12.5
  ENST ID: ENST00000578794
  CDS Start-End: 320-508
acattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctatacta

SEQ ID NO: 178142 - DNA, 1732 bp, Homo sapiens
  Payload ID: 14962
  Gene Symbol:
  Gene Name: RP11-15K19.2
  ENST ID: ENST00000426595
  CDS Start-End: 994-1671
cctctaggaccggaaaattctgggaaggctcgaggccgcggtccccggggtccgcatagtcccgatgaaaaacagacccgggaaagctggtgggagtcaggagccccggcgatgaggattgcgatgaaggaagcaggctcggagcgccgccagcgcatgcgtattggggatctgaggccagcgtcttgcgccgccattgcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcggcggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaggtaataacaaccttcaagagccccttcatctcaactcggcataaacaaggcaagattctgagagtggccgcccctggaagcagaaattattcttgtggctatccattggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaa

SEQ ID NO: 178143 - DNA, 784 bp, Homo sapiens
  Payload ID: 14963
  Gene Symbol:
  Gene Name: RP11-162P23.2
  ENST ID: ENST00000546840
  CDS Start-End: 6-784
acctcatggacctggcaggaaacaaggctgcagccttggatatagccatgattaaaatggtcgccccgtccatggcctcccgagtgattgatcgtgcgattcagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactga

SEQ ID NO: 178144 - DNA, 495 bp, Homo sapiens
  Payload ID: 14964
  Gene Symbol:
  Gene Name: RP11-166N6.3
  ENST ID: ENST00000565169
  CDS Start-End: 1-206
aagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcagaagctgcggcagatcctgtttggaaacacagtccatgtctttagctataactggaaaaaggcctatttcaggttccatgatccttcttctgaactagctttcactctggaagtgggaaaggtgatgttcattccaatggtttcctactcctgccttctgcattatagcttatgtgaaataagcaagaaggagcaggagcaagccttggccgcggcgcttgctggcatcctgtgggctgcaggagcagctcagaaggccaccatctgtcttgtcactgaggacatttacgttgcgtcgactccggactactctgtggacaatttcactgagcga

SEQ ID NO: 178145 - DNA, 693 bp, Homo sapiens
  Payload ID: 14964
  Gene Symbol:
  Gene Name: RP11-166N6.3
  ENST ID: ENST00000562308
  CDS Start-End: 1-148
gttaaccatggtggggacagccttcttcatgtacaatgcttttggaaaaccttttgaaactctgcatggtcccctagggctgtaccttttgagcttcatttcagaagctgcggcagatcctgtttggaaacacagtccatgtctttagctataactggaaaaaggcctatttcaggttccatgatccttcttctgaactagctttcactctggaagtgggaaagggaggggcccgaagcattcagatggctgtgcaaggatccatcatcaaatacttgttgtttaccaggaaaggaaaagactgtaaccttggcaacttatgtgaaataagcaagaaggagcaggagcaagccttggccgcggcgcttgctggcatcctgtgggctgcaggagcagctcagaaggccaccatctgtcttgtcactgaggacatttacgttgcgtcgactccggactactctgtggacaatttcactgagcgactccagctgtttgaatttttagagaaagaagccgctgagaaattcatctacgatcacttactatgtttcagaggggaaggaagccatggtgtcatcctgtttctgtacagcctgatcttctctagaacatttgaaaggcttcaaatggacctagatgtcaccaccactcagctgctacaaccaaatgctggaggctttctgtgcaggcagg

SEQ ID NO: 178146 - DNA, 1189 bp, Homo sapiens
  Payload ID: 14964
  Gene Symbol:
  Gene Name: RP11-166N6.3
  ENST ID: ENST00000569170
  CDS Start-End: 1-218
aagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggaagagcaggaaccacatctggttcaccttggaacctccaagtccctggtgtgtagggaagagtcaaaatacatttactgaactcaacaggatggtttattgcccgacctctctctcccatcataagaacttcccgttttcagttcctcccattatccaaatggatatggaggtcttgggccaggaacaaagctccgaacagctggatttagaggagatctcaaggaaaatttcattccttgacaaatggagggaaatctttagttatcacaggttgggaaccaataattcaactcctcagaatcatgaaggcaaccatacatctgctgatgaaaatgaagatggaacaggactatctcagcccaaaggacaaggacatttgccatcaagtggcctttgttctattcccaacccctctatcatctcttcaaaattgggtggctttcctatctccctagcaatggccacgaagctgcggcagatcctgtttggaaacacagtccatgtctttagctataactggaaaaaggcctatttcaggttccatgatccttcttctgaactagctttcactctggaagtgggaaagcttatgtgaaataagcaagaaggagcaggagcaagccttggccgcggcgcttgctggcatcctgtgggctgcaggagcagctcagaaggccaccatctgtcttgtcactgaggacatttacgttgcgtcgactccggactactctgtggacaatttcactgagcgactccagctgtttgaatttttagagaaagaagccgctgagaaattcatctacgatcacttactatgtttcagaggggaaggaagccatggtgtcatcctgtttctgtacagcctgatcttctctagaacatttgaaaggcttcaaatggacctagatgtcaccaccactcagctgctacaaccaaatgctggaggctttctgtgcaggcaggcagttctgaacatgattttaactggaagagcaagtcccaatgtcttcaatggctgtgagga

SEQ ID NO: 178147 - DNA, 3860 bp, Homo sapiens
  Payload ID: 14965
  Gene Symbol:
  Gene Name: RP11-176H8.1
  ENST ID: ENST00000549185
  CDS Start-End: 49-252
agcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggatctacgactctggctccactgattaccttaaccatattacatggatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagtgtctccttgaacttcagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagtgttcacagcatcttcaccaggagtagattccatctgcagaaaccatctagaatgataatcctttccagaaggttttcagttactttgcctggatccatccgtctgtggcagctgtagccttataaaatgtattttttaaataag

SEQ ID NO: 178148 - DNA, 474 bp, Homo sapiens
  Payload ID: 14965
  Gene Symbol:
  Gene Name: RP11-176H8.1
  ENST ID: ENST00000547378
  CDS Start-End: 15-218
cgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggatctacgactctggctccactgattaccttaaccatattacatggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagctgtaagtgaaacattaaaacaga

SEQ ID NO: 178149 - DNA, 749 bp, Homo sapiens
  Payload ID: 14965
  Gene Symbol:
  Gene Name: RP11-176H8.1
  ENST ID: ENST00000547760
  CDS Start-End: 1-190
gattcctcaggcccgggcgctcctacagcagtgcctgcacgcccggctgcaaattcgcccagccgatggggacgtcgcggcccagtgggtggaggtaacgtcagcccggcagctctcgttatcctccggcgtgcggggcggttttttccgcgttgtctcggtgactcgtccgctctgtgtctccctctgagaccggcggtccggccgcggggataccgggtcagcttgaagctggccgcggtggcctgcctggctgcgcttgtcttttcggtccagcatcaccgttccccagcgccagttgtagcacccgagaggaagagcgtgtctcccttcttggggggaccacaggtccaaagaggactggtgatctacgtgtgctttttcaagggagctgataaagaacttcttcccaaaatggatctacgactctggctccactgattaccttaaccatattacatggagtctcgttctgtcacccaggctggagtgcagtggcgtgatctcggctcactgcaacctctgcctcccagcttcaagcaattctcctgcctcagcctcccgagtagctgggactataagtgcacaccaccatgccctgctaatttttgtatttttagtagagacggggtttcaccatgttggccaggctggtcttgaactcctgagctcgtgatccacccacctcggcctcccaaagtgttgggattacaggcatgagccaccacgcccggccgacaaataatctt

SEQ ID NO: 178150 - DNA, 481 bp, Homo sapiens
  Payload ID: 14966
  Gene Symbol:
  Gene Name: RP11-178C3.1
  ENST ID: ENST00000591035
  CDS Start-End: 1-165
tcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagatttctggttcagtaagggtgagagccaggctccagactatagtgaattttccgaggagatatgtgtgggtcctgaataccatcccaagtgtccttataagagagaggcaaaagaggcaatagagacacagaaaagaaagccatgtgaagatggagcagagagatatatggccacaagccaaggaatgctgacagctgccagaagctggaagaaggcaaggaatggactctcccctacagcctccagaggcaatgcagccctgccaacactttgattttagacttctggcctatagaactgagaaagaataaatttctgttcttttcagcta

SEQ ID NO: 178151 - DNA, 953 bp, Homo sapiens
  Payload ID: 14967
  Gene Symbol:
  Gene Name: RP11-178L8.4
  ENST ID: ENST00000568879
  CDS Start-End: 1-713
tccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcat

SEQ ID NO: 178152 - DNA, 408 bp, Homo sapiens
  Payload ID: 14968
  Gene Symbol:
  Gene Name: RP11-190A12.7
  ENST ID: ENST00000544342
  CDS Start-End: 1-135
ctcaaagaggaggcccagaaacgccgtgagcgcatcgatgagatcaagaggaaaaagcttgaagagctgagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcagcacgacctgcagtgcccatgtgctggacagagggc

SEQ ID NO: 178153 - DNA, 558 bp, Homo sapiens
  Payload ID: 14968
  Gene Symbol:
  Gene Name: RP11-190A12.7
  ENST ID: ENST00000536764
  CDS Start-End: 1-174
gtgcagaaccggattgccacctttgaggagggccggcgcctcaaagaggaggcccagaaacgccgtgagcgcatcgatgagatcaagaggaaaaagcttgaagagctgagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaa

SEQ ID NO: 178154 - DNA, 308 bp, Homo sapiens
  Payload ID: 14968
  Gene Symbol:
  Gene Name: RP11-190A12.7
  ENST ID: ENST00000536779
  CDS Start-End: 1-186
ctcaaagaggaggcccagaaacgccgtgagcgcatcgatgagatcaagaggaaaaagcttgaagagctgagttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggc

SEQ ID NO: 178155 - DNA, 1033 bp, Homo sapiens
  Payload ID: 14969
  Gene Symbol:
  Gene Name: RP11-192H23.4
  ENST ID: ENST00000531839
  CDS Start-End: 25-1033
agagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggtatgcacagagtcctggaaaggattgtgggaagagctaggccacagatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatg

SEQ ID NO: 178156 - DNA, 2091 bp, Homo sapiens
  Payload ID: 14969
  Gene Symbol:
  Gene Name: RP11-192H23.4
  ENST ID: ENST00000481916
  CDS Start-End: 23-538
agagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggagggaggtggggggtcagccccccgcccggccagccgccccgtccgggagggaggtgggggggggggtcagcccccctgcccggccagccgccccgtccgggaggtgaggggcgcctctgcccggccgcccctactgggaagtgaggagcccctctgcccggccaccaccccgtctgggaggtgtgcctaacagctcattgagaacgggccaggatgacaatggcggctttgtggaatggaaaggcgggaaaggtggggaaaagattgagaaatcggatggttgccgtgtctgtgtagaaagaagtagacatgggagacttttcattttgttctgcactaagaaaaattcctctgccttg

SEQ ID NO: 178157 - DNA, 511 bp, Homo sapiens
  Payload ID: 14969
  Gene Symbol:
  Gene Name: RP11-192H23.4
  ENST ID: ENST00000577790
  CDS Start-End: 21-389
agaggaggcagaggctgggaatgggagcagtaagctgtcggcaggggcagcacacccagcagggggaacacacccgggtggctgtccctcacaagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagct

SEQ ID NO: 178158 - DNA, 2103 bp, Homo sapiens
  Payload ID: 14969
  Gene Symbol:
  Gene Name: RP11-192H23.4
  ENST ID: ENST00000584196
  CDS Start-End: 37-552
agcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaattaaatt

SEQ ID NO: 178159 - DNA, 902 bp, Homo sapiens
  Payload ID: 14970
  Gene Symbol:
  Gene Name: RP11-195F19.29
  ENST ID: ENST00000556278
  CDS Start-End: 61-902
gagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagat

SEQ ID NO: 178160 - DNA, 338 bp, Homo sapiens
  Payload ID: 14971
  Gene Symbol:
  Gene Name: RP11-195F19.5
  ENST ID: ENST00000544078
  CDS Start-End: 73-336
agggagggcgggagtttaggctgcgctgacccctctcagccccccctccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaac

SEQ ID NO: 178161 - DNA, 465 bp, Homo sapiens
  Payload ID: 14971
  Gene Symbol:
  Gene Name: RP11-195F19.5
  ENST ID: ENST00000416454
  CDS Start-End: 73-183
agggagggcgggagtttaggctgcgctgacccctctcagccccccctccaggagacgttcggagcccaggacatgtcgggaatgaggagatacgaggtggcgctggaggcggaggaggagatctactggggctgtttctactttttcccctggcttcgcatgtggcggagggagcggaggtgaggaggctgcgataccgcggacccgccccgggcatggacgggactcagtctctgaggacccatcggggggaatccggtagctcccgccccgcctcatgccagtgtcgggtcgccccacagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 178162 - DNA, 477 bp, Homo sapiens
  Payload ID: 14971
  Gene Symbol:
  Gene Name: RP11-195F19.5
  ENST ID: ENST00000423809
  CDS Start-End: 85-195
caccccttccgggggacaggcaaacctagtgcgcaacggcatccctgtgacgtaatagtaacggagacgttcggagcccaggacatgtcgggaatgaggagatacgaggtggcgctggaggcggaggaggagatctactggggctgtttctactttttcccctggcttcgcatgtggcggagggagcggaggtgaggaggctgcgataccgcggacccgccccgggcatggacgggactcagtctctgaggacccatcggggggaatccggtagctcccgccccgcctcatgccagtgtcgggtcgccccacagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaa

SEQ ID NO: 178163 - DNA, 1525 bp, Homo sapiens
  Payload ID: 14971
  Gene Symbol:
  Gene Name: RP11-195F19.5
  ENST ID: ENST00000421828
  CDS Start-End: 391-654
gtccgtttccggggtggagccagggagggcgggagtttaggctgcgctgacccctctcagccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggagctcggcgcaccccggggagcagaagctggagcctctgcgaggcctgatgagctgtctgtccagcggcctgggtcctactccccagcgctcgggtcgtggcttcccccgccgcagccccaccgccgctgcccagccagccagtgcattaaagatttaaaccgaagcccaccgtactgacctcctgactctgccgccgctgtcgccattcgagccgagcgcccctccccacacgggctctgttccgtactgacagggcgtccctccctggaagggtgcccttccacgtcaaagcccctcatcagtgtcaggcctcctgttactatcaatggctgtctcccccaatcccaacccccaaaaacccatactgtgagtcgcctatatgaagagaactaaataatcctgcctgttactcccttcctcggagcgaggactttgccagctgtctgaagaatcttctctgctgggagtatatctaaaacattttaagcagaggtgtaggatgcaggctgtaaatggtaagagggggagattcctagaagctgcctgccacagaggagcgacttgggttggcgacctttcctacagttcataccccaacttttggctcctccagtctgatcccaagtttagagatccttggcatcagcctacctagaagttcttgctccctccctaggagagtccaagggccactgctctttgccgcccccttctgtcacccaatcagcctgggacccactaactcctcaagtggtgagaatcagggactgctatgtgggcctgccttcagttagggactggacccagcaccagaaagggcaccacaagattaagttaaagaaagagatggcccagtttctggctggggccaaagctacagcagattgtggctggggagaagacttggtcttaaaggggagagatgggtgcacacccaaaagcatttgttttctgccttccgaagacttctggaccgacaagcccagggaagaccagaaagtatgtagcgcacagccaagtgatgaaga

SEQ ID NO: 178164 - DNA, 725 bp, Homo sapiens
  Payload ID: 14972
  Gene Symbol:
  Gene Name: RP11-196G11.1
  ENST ID: ENST00000529564
  CDS Start-End: 228-725
gcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggtcttcaagccgctcagcgtgcctgtggacagcgtggccccggcccccccaagcctcaggagggcaacacagtccctggcgagtggccctggcaggccagtgtgaggaggcaaggagcccacatctgcagcggctccctggtggcagacacctgggtcctcactgctgcccactgctttgaaaaggcagcagcaacagaactgaattcctggtca

SEQ ID NO: 178165 - DNA, 2362 bp, Homo sapiens
  Payload ID: 14972
  Gene Symbol:
  Gene Name: RP11-196G11.1
  ENST ID: ENST00000533518
  CDS Start-End: 1-365
gcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggtcttcaagccgctcagcgtgcctgtggacagcgtggccccggcccccccaagcctcaggagggcaacacagtccctggcgagtggccctggcaggccagtgtgaggaggcaaggagcccacatctgcagcggctccctggtggcagacacctgggtcctcactgctgcccactgctttgaaaaggcagcagcaacagaactgaattcctggtcagtggtcctgggttctctgcagcgtgagggactcagccctggggccgaagaggtgggggtggctgccctgcagttgcccagggcctataaccactacagccagggctcagacctggccctgctgcagctcgcccaccccacgacccacacacccctctgcctgccccagcccgcccatcgcttcccctttggagcctcctgctgggccactggctgggatcaggacaccagtgatgctcctgggaccctacgcaatctgcgcctgcgtctcatcagtcgccccacatgtaactgtatctacaaccagctgcaccagcgacacctgtccaacccggcccggcctgggatgctatgtgggggcccccagcctggggtgcagggcccctgtcagggagattccgggggccctgtgctgtgcctcgagcctgacggacactgggttcaggctggcatcatcagctttgcatcaagctgtgcccaggaggacgctcctgtgctgctgaccaacacagctgctcacagttcctggctgcaggctcgagttcagggggcagctttcctggcccagagcccagagaccccggagatgagtgatgaggacagctgtgtagcctgtggatccttgaggacagcaggtccccaggcaggagcaccctccccatggccctgggaggccaggctgatgcaccagggacagctggcctgtggcggagccctggtgtcagaggaggcggtgctaactgctgcccactgcttcattgggcgccaggccccagaggaatggagcgtagggctggggaccagaccggaggagtggggcctgaagcagctcatcctgcatggagcctacacccaccctgaggggggctacgacatggccctcctgctgctggcccagcctgtgacactgggagccagcctgcggcccctctgcctgccctatcctgaccaccacctgcctgatggggagcgtggctgggttctgggacgggcccgcccaggagcaggcatcagctccctccagacagtgcccgtgaccctcctggggcctagggcctgcagccggctgcatgcagctcctgggggtgatggcagccctattctgccggggatggtgtgtaccagtgctgtgggtgagctgcccagctgtgagggcctgtctggggcaccactggtgcatgaggtgaggggcacatggttcctggccgggctgcacagcttcggagatgcttgccaaggccccgccaggccggcggtcttcaccgcgctccctgcctatgaggactgggtcagcagtttggactggcaggtctacttcgccgaggaaccagagcccgaggctgagcctggaagctgcctggccaacataagccaaccaaccagctgctgacaggggacctggccattctcaggacaagagaatgcaggcaggcaaatggcattactgcccctgtcctccccaccctgtcatgtgtgattccaggcaccagggcaggcccagaagcccagcagctgtgggaaggaacctgcctggggccacaggtgcccactccccaccctgcaggacaggggtgtctgtggacactcccacacccaactctgctaccaagcaggcgtctcagctttcctcctcctttaccctttcagatacaatcacgccagccacgttgttttgaaaatttctttttttggggggcagcagttttcctttttttaaacttaaataaattgttacaaaata

SEQ ID NO: 178166 - DNA, 499 bp, Homo sapiens
  Payload ID: 14972
  Gene Symbol:
  Gene Name: RP11-196G11.1
  ENST ID: ENST00000532364
  CDS Start-End: 188-499
attcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccagggcagcagcaacagaactgaattcctggtcagtggtcctgggttctctgcagcgtgagggactcagccctggggccgaagaggtgggggtggctgccctgcagttgcccagggcctataaccactacagccagggctca

SEQ ID NO: 178167 - DNA, 753 bp, Homo sapiens
  Payload ID: 14973
  Gene Symbol:
  Gene Name: RP11-201K10.3
  ENST ID: ENST00000473363
  CDS Start-End: 1-85
gggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgt

SEQ ID NO: 178168 - DNA, 1944 bp, Homo sapiens
  Payload ID: 14974
  Gene Symbol:
  Gene Name: RP11-20I23.1
  ENST ID: ENST00000564543
  CDS Start-End: 118-1248
agggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 178169 - DNA, 596 bp, Homo sapiens
  Payload ID: 14975
  Gene Symbol:
  Gene Name: RP11-20I23.3
  ENST ID: ENST00000569317
  CDS Start-End: 140-596
ggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgc

SEQ ID NO: 178170 - DNA, 729 bp, Homo sapiens
  Payload ID: 14976
  Gene Symbol:
  Gene Name: RP11-212D19.4
  ENST ID: ENST00000544347
  CDS Start-End: 1-446
cggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgattactctagtttgatgtcataatttctcatggagttaaaactggactcttcaaaatgatagagttgtctgaatttggctgcaatgcgaactactaatcgattcaagcttgttatcaagacacctagagatcaccagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaa

SEQ ID NO: 178171 - DNA, 504 bp, Homo sapiens
  Payload ID: 14977
  Gene Symbol:
  Gene Name: RP11-214K3.25
  ENST ID: ENST00000618862
  CDS Start-End: 1-392
gcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgatcggtgttgctggaagtcggtccaggagctttttggataatccacctcatgactggaaaacaacgaagaaacccagtagcttcttcgccgtgtggattcagaccccgggagcccaggcctgcacctgggcagctgctccctgcacgtggccggacatatggaatatggagccccgctgccttggagtcagagagctgccaagtagaatttgcatgtaatgctgctatcattttcaattgctctcccaataaaacaggccctggagccgaggtgaatgccgtagaaggcattttttccactgggtgtgggtccagaataaataatcaaaag

SEQ ID NO: 178172 - DNA, 700 bp, Homo sapiens
  Payload ID: 14978
  Gene Symbol:
  Gene Name: RP11-215A19.2
  ENST ID: ENST00000509111
  CDS Start-End: 1-296
agcccgtgctccgcggggacggcgcgcggccctcgtggctggcgtccgccctggcctgcgtcctcatcttcaccatcgtggtggacatcctgggcaacctcctggtcatcctgtcggtgtatcggaacaagaagctcaggaacgcaggctgccaacatgaagacactggatgcggaatcaggaggagatgtatacagctcagtctccaaagccaggacaagccagctccaacacactactggctgaatctcaccaatcgttatagttttgttttttgtttttttaaatgtatttaagcatttttaggtgttttaaattttatgtgtgtattctaggaatatgtactcagattctttcattaggcatgtgttattaacaacattcatcttcttaaaggctgaaccaactttgcgcgttttatcaacagatattcactgagcacctaatattgccaggctgtgctcaaggcagtgggattcatcagtgaacaatacagacaaaaatcactgacctaaatggagcttgaagtttatatctaaatcattcaaagattctgtggtggaaaagaagttagaaatctttcagctgcaaaacataagccaaaatacaactcacctttggaatcagagaacttacaggttcataaaattgcgaagcccagatgtgcacctgaggtgagacttcgtccagcttctgtctg

SEQ ID NO: 178173 - DNA, 2420 bp, Homo sapiens
  Payload ID: 14979
  Gene Symbol:
  Gene Name: RP11-216L13.16
  ENST ID: ENST00000435202
  CDS Start-End: 1-462
gctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctggctggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacgtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttccagatgtcaagtggagaccacggcttgttgagaggtgtttggtgactctaggtcattgacagtgtgaaaatcaagtggctcaagggatcctttatgatcacagaaagatgggggaaggaggatacaggctgaccgggtggcgagatgtcagccaggccccttccccactgtcttctggagcacactgcaggctgctgctattccctgtctgctgtgaaacagaccacaggccggcccaacgcagtcctcgccgtgtgccttgcctctgccctccacgccgccgccaccctccgcgttcctttacatcctgcactttctcaggaagccgttcgcatatccacccaacatggaggagcccccatgacgtgccaggcagcgtgctggcccctgcggctgcgttagggaacagaatcggcaaacgcagtcccagagttgatgcctgatcaggagaagccaacttcagcagtgtggtcacctggatactcgagtatagaccctagatcacctggatactcgagtatagaccctagaagtgtatctaggcgcggccagggccccacaacagcaggtctgactcattccatccagggcagcatcagggagagcttcctgggggaagtggcatttgggctgacctgggaagggtggtgggtgttaagtcagtttgggtggggctggaggagcaggggtgcatccccagaacaggatgtgacttctgaaaagacatcagagtagagaaaatggtttctcaaggagattggggacgccagtatcagaatggcggcggggagagccacagaggagcaggagggggcccaccagaccacggcacctcgaaggctgcggtgaaggcttaggtctcactcaaggggtgatgacgggaggttgtctgagatgaaccccccaactgaatgaatggaccttcttctggccaaggggatcccaaagaaaccctgaacccgagtcctcagccatgacggggtaaggggtcagcccctccttctggcccgagaagagatcagagattggttctgggcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgttccaggcttctggcctgaggctacgcttcctagcctgtcagaagggctgccctgctggctgcaatctcttatgagaaataaagctctcctgtgtgcaaaaaagta

SEQ ID NO: 178174 - DNA, 735 bp, Homo sapiens
  Payload ID: 14980
  Gene Symbol:
  Gene Name: RP11-216L13.17
  ENST ID: ENST00000456614
  CDS Start-End: 1-121
cttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagagcagtgtcgggcactccagatccaaggggtgaaagagaatatggaccagaacaaggccacgctggccctcctgcgcagcaacatccgccgcggggcccaggactgggctttggccaagaaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgagcccagcggcccgggaagggcgggggtcaggggctgggatctgggaggggcgggagcgtcctggggcggagccgccccgcacccgccagggagaggga

SEQ ID NO: 178175 - DNA, 2306 bp, Homo sapiens
  Payload ID: 14981
  Gene Symbol:
  Gene Name: RP11-219A15.1
  ENST ID: ENST00000456009
  CDS Start-End: 86-2263
ctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaataggagaaaagaaatgccgatatgttgtataataaagatagtgaacagttaagaataaaagaagaggagtgtgggaaagtggttgaaacaaagca

SEQ ID NO: 178176 - DNA, 8802 bp, Homo sapiens
  Payload ID: 14981
  Gene Symbol:
  Gene Name: RP11-219A15.1
  ENST ID: ENST00000448331
  CDS Start-End: 141-4418
ggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctgctggaggtatcatcagtgaagtctgtgaaacagcaaagatggctgcctgccacttcctctggaagctccagcccagcagcgtactgacttattgctggctcgaaagtgcatgtaaatataaatgtaggtgcataatatagactttttctgaatggtttataagttgcagtgctgggattacaagcgtgagctaccacacccagcgaggaagccaagtttaacgtgtgtgctccactcctccaacctggccaaagggcagtcatcatcactggccactactgaccacagcctttagaaactccccttgaacgtgctgggctgaccttcctctgatcacaggcaaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcagcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctc

SEQ ID NO: 178177 - DNA, 765 bp, Homo sapiens
  Payload ID: 14982
  Gene Symbol:
  Gene Name: RP11-229P13.27
  ENST ID: ENST00000622933
  CDS Start-End: 1-327
accaacggcaacagatgctgtgcctggagcggcataaagagccacccaaggagctggacacggcctcctcggatgaggagaatgaggacggagacttcacggtgtacgagtgcccgggcctggccccgcctggaaagcccctctgctgcaggctggaggaagggaccctgggcccagcctatagtcagcggtgtctatgggcatggatctggacggggaaaaggacaaagcagcctccatccacagttcattccgggaccaggcccttgcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgct

SEQ ID NO: 178178 - DNA, 746 bp, Homo sapiens
  Payload ID: 14982
  Gene Symbol:
  Gene Name: RP11-229P13.27
  ENST ID: ENST00000625047
  CDS Start-End: 1-232
cctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctg

SEQ ID NO: 178179 - DNA, 1342 bp, Homo sapiens
  Payload ID: 14983
  Gene Symbol:
  Gene Name: RP11-231C14.4
  ENST ID: ENST00000458643
  CDS Start-End: 33-1295
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 178180 - DNA, 1861 bp, Homo sapiens
  Payload ID: 14983
  Gene Symbol:
  Gene Name: RP11-231C14.4
  ENST ID: ENST00000550665
  CDS Start-End: 76-1861
tcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtca

SEQ ID NO: 178181 - DNA, 710 bp, Homo sapiens
  Payload ID: 14983
  Gene Symbol:
  Gene Name: RP11-231C14.4
  ENST ID: ENST00000547235
  CDS Start-End: 1-74
agcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggtatgaggttcttcctgccatcctgccatcatttgttttttatgttttgtcgccataagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatga

SEQ ID NO: 178182 - DNA, 675 bp, Homo sapiens
  Payload ID: 14983
  Gene Symbol:
  Gene Name: RP11-231C14.4
  ENST ID: ENST00000550690
  CDS Start-End: 245-394
tttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatc

SEQ ID NO: 178183 - DNA, 910 bp, Homo sapiens
  Payload ID: 14983
  Gene Symbol:
  Gene Name: RP11-231C14.4
  ENST ID: ENST00000551448
  CDS Start-End: 62-184
gtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacatt

SEQ ID NO: 178184 - DNA, 464 bp, Homo sapiens
  Payload ID: 14983
  Gene Symbol:
  Gene Name: RP11-231C14.4
  ENST ID: ENST00000552123
  CDS Start-End: 1-236
ggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagatcaaccacatccttcaaaaggactatgcctgtttataagcccagctgtttctgccctgtgaaacacggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacct

SEQ ID NO: 178185 - DNA, 797 bp, Homo sapiens; identical to SEQ ID NO: 172532
  Payload ID: 14983
  Gene Symbol:
  Gene Name: RP11-231C14.4
  ENST ID: ENST00000549733
  CDS Start-End: 1-207

SEQ ID NO: 178186 - DNA, 1216 bp, Homo sapiens
  Payload ID: 14983
  Gene Symbol:
  Gene Name: RP11-231C14.4
  ENST ID: ENST00000617311
  CDS Start-End: 55-807
agccacctccacctctgtcctggccgcctcagggcgccctgaaaggaccaggacatgcgggtgcggtggatgctcttttggctcctctttgggctcctactggaatttatcagccatcagtgcatctctgttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgtgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctctt

SEQ ID NO: 178187 - DNA, 2550 bp, Homo sapiens
  Payload ID: 14984
  Gene Symbol:
  Gene Name: RP11-231C18.3
  ENST ID: ENST00000507166
  CDS Start-End: 1-2550
atgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaa

SEQ ID NO: 178188 - DNA, 770 bp, Homo sapiens
  Payload ID: 14985
  Gene Symbol:
  Gene Name: RP11-234B24.6
  ENST ID: ENST00000544741
  CDS Start-End: 1-252
gtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactg

SEQ ID NO: 178189 - DNA, 4753 bp, Homo sapiens
  Payload ID: 14986
  Gene Symbol:
  Gene Name: RP11-235E17.2
  ENST ID: ENST00000572919
  CDS Start-End: 31-1467
cagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtagagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggcggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttggtgcggccagaggctcaggcctcgtgggcgagggtgtgggtggtggggaaggggtgtggacatttcgggagacctccccgaccccaggcccaggctctgccctggactccttcccagcttgcgggagcgatggatggagaacgtggagaacctcgtatccctgcgcccatctcccctgcctcaggctgtacaggagacccgcccccttcccgcttctcagttcctctcctttaaccttgaggtcctgtggggctgagtgtgtggtgactcaggtccctgattgtagacggggtgtactcggttagaaagcatgcaggggccgggcatggtggctcatgcctgtaatcccagcactttgggaggctgaggtgggcagatcacctgaggtctggagtttgagaccagcctgaccaacatggtgaaaccccgtctctactaaaaacaccaaattaactgggtgtggtggagcctgcctgtaatcccagctactcagggaggctgagacaggagaatcgcttaaaccttggaggcagaggttgtgatgagctgagatggcaccactgcactccaggctggtcaacaagagtgaaactctgtctcaaaaaaaaaaaaagaaaaa

SEQ ID NO: 178190 - DNA, 2413 bp, Homo sapiens
  Payload ID: 14987
  Gene Symbol:
  Gene Name: RP11-240B13.2
  ENST ID: ENST00000262283
  CDS Start-End: 101-2170
ctgactctcttttcggactcagcccgcctgcacccaggtgaaataaacagctttattgctcacacaaagcctgtttggtggtctcttcacacggacgcgcatgaaatttggtgccgtcactcggatcgggggacctcccttgggaaatcaatccccgtcctcctgttctttgctccatgagaaagatccacctacgacctcaggtcctcagacagaccagcccaagaaacatctcaccaatttcaaatccgctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctaccttgggagcattcacccatggcacacagactccgagtccaaccaaggcaacagcccccagatatccacaaacaggtgatctctctgcagagtggccattcactgctggtgaagagccagtcctggtcccaagaccccatcaagtttcaagagtccgttccagttgctgcctaagccccatcctttgttctcctgctatgattgcgtttctcctcaccagtgtgctgatgatcccccatgccggaggccatcctctggacactccacatcttccacaggagctgcctccaggactcccaaacaatatcaatatcactttcttcagtgggatgtttaaaaatgtggaaagtgtggctgaaatttttgattgcctgggcccccacttcacctggctgcaggctgtcttcaccaatttccctgtgctgatccagtttgtcaatggtatgaagtgtgtggctggtctctgcccccgagactttgaagactatggttgcacctgcaggtttgagatggaagggttgcctgtggatgaatctgacagctgctgcttccagcaccgcaggtgctatgaggaggccgctgagatggactgtctccaagaccccgccaaacttagcacagaggtcaattgtgtcagcaagaagatcatatgtgagtccaaggacaactgtgagcacctgctgtgtacctgtgataaggctgccatagagtgcttggctcgatccagcctcaactcttccctgaaccttctggacacctccttctgcctggctcagactccagagacaaccatcaaggaagacttgacaacacttctgcccagagtggttcctgtggagcccacagacaccagcctgacagccctttcaggagaagtggctgcagagactgaggctgacagactgatcactctctccaagaaaaaagcaggccacgatcaggaaggagtgggagctgctagggctacgtcccctccaggatctgcagagatagttgcaacaagggttacagctaaaattgtaacccttgtccctgctggcattaaatctctggggctggcagtgtcatctgttgaaaatgatcctgaggagaccactgaaaaagcctgtgacagattcaccttcctgcacctgggaagtggggacaacatgcaggtgatgccacagcttggagagatgctcttttgtctgacatcccggtgcccggaggaatttgagtcttatggctgttactgtggacaagaaggaagaggcgagccaagggatgacctagacaggtgctgcttgtcccatcactgctgcctagagcaagtgagaaggctgggctgcctgcttgagaggcttccttggtcaccggtggtgtgtgtggatcatacgcccaagtgtgggggccaaagcctgtgtgagaagttgctctgtgcctgtgaccagacggcagctgagtgcatgacctctgcctcctttaaccaaagcctcaagtccccaagcagactcgggtgccctgggcagccagcagcctgtgaagacagcctgcaccctgtgcccgcagcccccaccctgggctccagctctgaggaggacagcgaggaggaccctccacaggaggacctcggcagagccaagaggtttctgcggaagtcactgggtcccttggggatcgggcctcttcatggaagatagatgcccagagaaaatggctaacaccttcagtagcgtggctcctgctccaccttcagctctttatctctcagcctcctctgtcccttggagccttcttcccttcctttaactcagaggcggggagggaacagaggccgtgagccctgcccatgcctcatcagctgtggtcacctcacaagccaatgtacacttggagaaggcacaccatggtacctccatgctcctttagtgcactgtggaagc

SEQ ID NO: 178191 - DNA, 3099 bp, Homo sapiens
  Payload ID: 14988
  Gene Symbol:
  Gene Name: RP11-244H3.4
  ENST ID: ENST00000487874
  CDS Start-End: 186-2357
ggggcggtgccaggtgggctacgcggctggggcggctgcggatatcgccttagggacgcgttgacattcactggctagtccaccgctctcagtcggagaccacattgcctcgtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtt

SEQ ID NO: 178192 - DNA, 492 bp, Homo sapiens
  Payload ID: 14989
  Gene Symbol:
  Gene Name: RP11-248J23.7
  ENST ID: ENST00000491114
  CDS Start-End: 1-200
tgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagaaagttgaaataaaaggaccatcatgaaaaaatctcaaagagaagatatttttaaaaaggttgcttccaaatcttggctcttgtgaacagtgctgcaacaaacatgggagtgcagatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagctcattgatagcgaaatacatcaaaggtccaag

SEQ ID NO: 178193 - DNA, 242 bp, Homo sapiens
  Payload ID: 14990
  Gene Symbol:
  Gene Name: RP11-249C24.12
  ENST ID: ENST00000379816
  CDS Start-End: 59-199
cctgccccactgcttcttctcctctcccttaggaactctagcttcacctcgcttcgtaatggaccccaattgctcctgctccactactcctgcaaatgcagagagtgcaaatgcacctcctgcaagacgagctgctgctcctgctgccccgtgggctgtgccaagtgtgcccagggatgtgtttgcaaagggacactgacaagtgcagctgctgctcctgatgtagggaaagctgtgttccc

SEQ ID NO: 178194 - DNA, 1636 bp, Homo sapiens
  Payload ID: 14991
  Gene Symbol:
  Gene Name: RP11-257K9.8
  ENST ID: ENST00000423730
  CDS Start-End: 437-952
acttccgctcgagcgcgcctcgcgcggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggagaggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttgatggagtcttactctgtcgcccaggctggagtacaatggtgcgaactcagccacctgctacctctgccttctgggttcaagcaattctctgcctcagcctcctgagtaactggaattgcaggtcagagcagagcatggccatgggaacaagtgccctcagcaagaagccgtggtagaccctgcctgaaaactttcatgatccaatggtgtttcacatggaagaggaccaggaggagctcatctttggtgagtggcctttgcccacatcccctccttcatccttgtcttctccattttcaatttttcccttctttcctaccttcatcagtcacacatcggttcccccaaggctacctccccactccccaagggctggtgcttgatagaccctcctctcgcctcttatgctcacagggcatggtgacacataccttcactgcattgaggtgcacagcc

SEQ ID NO: 178195 - DNA, 1527 bp, Homo sapiens
  Payload ID: 14992
  Gene Symbol:
  Gene Name: RP11-26J3.4
  ENST ID: ENST00000522938
  CDS Start-End: 323-1159
gcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattata

SEQ ID NO: 178196 - DNA, 998 bp, Homo sapiens
  Payload ID: 14993
  Gene Symbol:
  Gene Name: RP11-277P12.6
  ENST ID: ENST00000539033
  CDS Start-End: 16-738
cacacagctgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatgaacaatataa

SEQ ID NO: 178197 - DNA, 883 bp, Homo sapiens
  Payload ID: 14994
  Gene Symbol:
  Gene Name: RP11-286N22.8
  ENST ID: ENST00000543044
  CDS Start-End: 34-498
gcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccag

SEQ ID NO: 178198 - DNA, 569 bp, Homo sapiens
  Payload ID: 14994
  Gene Symbol:
  Gene Name: RP11-286N22.8
  ENST ID: ENST00000538594
  CDS Start-End: 23-424
gtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggccccctggggccctgccccacagcatcatgatggggaaactccccctgggggtcgtctccccttatgtgaagatgagttcggggggctacacggaccccctgaaattctacgccaccagctactgcaccgcctacggtccggaaggtccatttcgacacccaggagcacgggcctc

SEQ ID NO: 178199 - DNA, 875 bp, Homo sapiens
  Payload ID: 14994
  Gene Symbol:
  Gene Name: RP11-286N22.8
  ENST ID: ENST00000544801
  CDS Start-End: 22-423
tttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcct

SEQ ID NO: 178200 - DNA, 580 bp, Homo sapiens
  Payload ID: 14994
  Gene Symbol:
  Gene Name: RP11-286N22.8
  ENST ID: ENST00000541135
  CDS Start-End: 92-580
agctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggtactggggagaaggttttatacaagaaaatggcacattctgaagtggagctcaacaggccccctggggccctgccccacagcatcatgatggggaaactccccctgggggtcgtctcc

SEQ ID NO: 178201 - DNA, 5059 bp, Homo sapiens
  Payload ID: 14995
  Gene Symbol:
  Gene Name: RP11-287D1.3
  ENST ID: ENST00000451608
  CDS Start-End: 1-576
aaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgtctctctccaccacagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggttaatggctgctcctggctagatcacaggaccctgcatgatactggaatgctccctggtgaggtactgcagagttacaggatcgtgaactctatttattcccacatcaatgactgctgctccttccttgatcatatctgctgtgatcagatttggaatacctggaaatggagaaaggaaagatcaacttagtactgaaaacagtctacctgtcagattcttgtctaacttcaatttcaagagaccctgaagaactaatcaacatgttttattaaaacctgttaaaaatattaactaa

SEQ ID NO: 178202 - DNA, 2785 bp, Homo sapiens
  Payload ID: 14996
  Gene Symbol:
  Gene Name: RP11-290H9.2
  ENST ID: ENST00000560629
  CDS Start-End: 1-2362
gactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcg

SEQ ID NO: 178203 - DNA, 771 bp, Homo sapiens
  Payload ID: 14997
  Gene Symbol:
  Gene Name: RP11-293I14.2
  ENST ID: ENST00000548802
  CDS Start-End: 1-255
tttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattg

SEQ ID NO: 178204 - DNA, 1084 bp, Homo sapiens; identical to SEQ ID NO: 103633
  Payload ID: 14998
  Gene Symbol:
  Gene Name: RP11-294C11.1
  ENST ID: ENST00000612201
  CDS Start-End: 99-1040

SEQ ID NO: 178205 - DNA, 353 bp, Homo sapiens
  Payload ID: 14999
  Gene Symbol:
  Gene Name: RP11-294C11.2
  ENST ID: ENST00000622410
  CDS Start-End: 1-353
atgaaacacctgtggttctttctcctcctggtggcagctcccagatgggtcctgtcccaggtgcagctgcaggagtcgggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccgtccctcaagagtcgagtcaccatatcagtagacaagtccaagaaccagttctccctgaagctgagctctgtgaccgccgcggacacggccgtgtattactgtgcgagaga

SEQ ID NO: 178206 - DNA, 1125 bp, Homo sapiens
  Payload ID: 15000
  Gene Symbol:
  Gene Name: RP11-294C11.3
  ENST ID: ENST00000623441
  CDS Start-End: 92-1042
tgtggcataccttgtgtttagttcaagaactataatctagatgtaacacctgaaaataaactcttttattgatattctacaggcagaagaaatgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaagaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccacatgcaccactcgtgtcattattatacttcttatgtttggacctgctatcttcatctacatatgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactggtacctcccatttgccaggtacca

SEQ ID NO: 178207 - DNA, 788 bp, Homo sapiens
  Payload ID: 15000
  Gene Symbol:
  Gene Name: RP11-294C11.3
  ENST ID: ENST00000629333
  CDS Start-End: 1-634
cctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaagaaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccacatgcaccactcgtgtcattattatacttcttatgtttggacctgctatcttcatctacatatgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactggtacctcccatttgccaggtaccattgtaggcaatggaggagagttatgcataatgagagaataaacttattatatttaaagaatataaaggaaa

SEQ ID NO: 178208 - DNA, 353 bp, Homo sapiens; identical to SEQ ID NO: 142128
  Payload ID: 15001
  Gene Symbol:
  Gene Name: RP11-294C11.4
  ENST ID: ENST00000630556
  CDS Start-End: 1-353

SEQ ID NO: 178209 - DNA, 997 bp, Homo sapiens
  Payload ID: 15002
  Gene Symbol:
  Gene Name: RP11-295K3.1
  ENST ID: ENST00000427721
  CDS Start-End: 213-997
cctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagac

SEQ ID NO: 178210 - DNA, 732 bp, Homo sapiens
  Payload ID: 15003
  Gene Symbol:
  Gene Name: RP11-295P9.13
  ENST ID: ENST00000595538
  CDS Start-End: 1-104
aaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatagccctaatttgtttagaactgtaatatgcacagttaaaacaacttgtcctctcaggaccttttgcagttagggttggtcgtatgacatggtcctgcgaagaagatacggatagaagtctgtgggccaccagtggattgaatgatgcccgtatgcactgagaagggccatgtgtttactcggtctaccaattcaaatgttaatctcatccaaaaacaccctcacagatacctttggaatgatgtttaaccaaatatttgggtaccgtcttccccagtgaagttgacacaaaattaaccatcacagctgccttcctgtgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaggccacggcccgccttgtccctgccgggtcccggcc

SEQ ID NO: 178211 - DNA, 761 bp, Homo sapiens
  Payload ID: 15003
  Gene Symbol:
  Gene Name: RP11-295P9.13
  ENST ID: ENST00000596044
  CDS Start-End: 1-57
tgccagaaacactttcctacagacccatccaaatgtgtggagtacaatgcactttagttaatgttccatataaagaaactgtcatgtgacaccagtacctcctaaaattggtcagtgtggtagatggtttagagaaaaaaggaacctgttccacagggctgtgaccattcgagggaagcacattcaaagatgtagatcccctcagagaagttttccatttccctgaagttaaagatcttcaaatgactgcaaataacatgaggatatatagaaaaatgcccttccccaatttccaaatcgtgaaaatttggctcagcagagccctaatttgtttagaactgtaatatgcacagttaaaacaacttgtcctctcaggaccttttgcagttagggttggtcgtatgacatggtcctgcgaagaagatacggatagaagtctgtgggccaccagtggattgaatgatgcccgtatgcactgagaagggccatgtgtttactcggtctaccaattcaaatgttaatctcatccaaaaacaccctcacagatacctttggaatgatgtttaaccaaatatttgggtaccgtcttccccagtgaagttgacacaaaattaaccatcacagctgccttcctgtgggcctcatgttatatgagaacagtattgggtgtacacttaaagcgttctgggaatatgaatcccttctgcaccctggaatcaccagtccagccatgcatggagctggggaaagcaggccctgaa

SEQ ID NO: 178212 - DNA, 1204 bp, Homo sapiens
  Payload ID: 15003
  Gene Symbol:
  Gene Name: RP11-295P9.13
  ENST ID: ENST00000601460
  CDS Start-End: 1-610
gaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcaggatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccagagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaa

SEQ ID NO: 178213 - DNA, 2326 bp, Homo sapiens
  Payload ID: 15004
  Gene Symbol:
  Gene Name: RP11-296A16.1
  ENST ID: ENST00000417761
  CDS Start-End: 1-329
agatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcatggcattacattggcatctgtggaggctttgcattcatcctactgcagttggtgcttattacagcttttgcccattcctggaacaagaactgagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactg

SEQ ID NO: 178214 - DNA, 835 bp, Homo sapiens
  Payload ID: 15005
  Gene Symbol:
  Gene Name: RP11-298I3.5
  ENST ID: ENST00000555074
  CDS Start-End: 1-580
gttaggagagaaagccagtcgcctgctggagaagttcggccgcagaaaggatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattg

SEQ ID NO: 178215 - DNA, 11692 bp, Homo sapiens
  Payload ID: 15006
  Gene Symbol:
  Gene Name: RP11-2C24.9
  ENST ID: ENST00000380361
  CDS Start-End: 1-9162
gtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaatactcctgtctaattgttctcctcctgctttcccttgggcccttggtgagagccagactggacatctgactgatagcagaagccagcatccacctcatccaggagctccaagagaaggaaacaatttttattttcttcttctggaagtttcccttcttggaaagaccccagcttctcccttgtacgtccacagagactctgaggccaagagtagtagcagctgctactatttattacttactatattccaggctgtgttctaagcactttatatttcttaacttcctccagttttcagtcactcagtagatgtctgtactatcatatccatcatatgaatatatcacatatgataggtaccaactatctgagtgaaaactggaagaaatgttctaaaatgacagtgttctcgttttatacttgaagaaacaaacagatttgcacaaggtcctcagctactaaatggtagagctgagactgaacccagacagtttggttccagagctgagagaggagtgaaagagttgggtaacagcaacaaccatcctgtacatggagatttgagtgattaaaatggattttcatatcttttatcttggacctcataatatttcaaattttttttaaaattatgaagtatatcatacatataggaaaatacccaaaacaagtatacagttcattaacacaaagcaaacgtgaataaccacattcagtaaagaaattggaacactgtcaacacttcaaagcctcctttatactcctcccaatcactgctacttcctttcttcccacaggtaaccaccattctgacttctagcagtgtcatttaattttgtctgcatttgaactttatataaatggaatcatgtattcttttcatgttaa

SEQ ID NO: 178216 - DNA, 939 bp, Homo sapiens
  Payload ID: 15007
  Gene Symbol:
  Gene Name: RP11-302B13.5
  ENST ID: ENST00000398092
  CDS Start-End: 150-782
cggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatgggcacgatctcggctcactgcaacctccgcctcccgggttcaagcaattctcctgtctcagcctcccctcagtgcacttttataaaccgtcctcagaacccttgggaagcccaagatcgtcaaaaagagaaccaagaagtttatccggcaccagtctgaccgatatgtcaaaattaagcgtaaccggcggaaacccagaggtattgacaacagggttcgtggaaggttcaagggttagatcttgatgcccaacattgattatgggagcaacaagaaaacaaagcacatgctgcccagtggcttccggaaattcctggtccacacgtcaaggagctggaagtgctgctgttgtgcaacaaatcttactgtgctgagatcgctcacaatgtttcctccaagaac

SEQ ID NO: 178217 - DNA, 654 bp, Homo sapiens
  Payload ID: 15008
  Gene Symbol:
  Gene Name: RP11-302M6.4
  ENST ID: ENST00000370453
  CDS Start-End: 188-346
aagcccgcgaagagaagtaggaggaaggcgccgccgtggccgcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcc

SEQ ID NO: 178218 - DNA, 4157 bp, Homo sapiens
  Payload ID: 15009
  Gene Symbol:
  Gene Name: RP11-307N16.6
  ENST ID: ENST00000382141
  CDS Start-End: 579-3896
gctgggcggggagccagagactgattcgctgcggtcctgggcccagcggctgggaggtcccgccctggccgaggaaatgaagagggcgcagggcatgggggcggcgcgcacccgggacagtttccagtcggcttctccgtgaccttcctcccccttccagctcggagcgggatgctgggatccctccaaggaccctctgaggacgtaggagggatgctgagacagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaagagcttgtcttcaagagtagctggtgcagaaactcgcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaag

SEQ ID NO: 178219 - DNA, 1974 bp, Homo sapiens
  Payload ID: 15010
  Gene Symbol:
  Gene Name: RP1-130H16.18
  ENST ID: ENST00000330168
  CDS Start-End: 1-732
gagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgcagggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttg

SEQ ID NO: 178220 - DNA, 1781 bp, Homo sapiens
  Payload ID: 15010
  Gene Symbol:
  Gene Name: RP1-130H16.18
  ENST ID: ENST00000418047
  CDS Start-End: 1-702
ggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggggtggatgggggtgccctgcccatcacccatctccctccccaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctg

SEQ ID NO: 178221 - DNA, 1818 bp, Homo sapiens
  Payload ID: 15010
  Gene Symbol:
  Gene Name: RP1-130H16.18
  ENST ID: ENST00000434291
  CDS Start-End: 1-1443
ggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggt

SEQ ID NO: 178222 - DNA, 1851 bp, Homo sapiens
  Payload ID: 15010
  Gene Symbol:
  Gene Name: RP1-130H16.18
  ENST ID: ENST00000447976
  CDS Start-End: 1-702
ggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctg

SEQ ID NO: 178223 - DNA, 1811 bp, Homo sapiens
  Payload ID: 15010
  Gene Symbol:
  Gene Name: RP1-130H16.18
  ENST ID: ENST00000434987
  CDS Start-End: 1-699
gtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttg

SEQ ID NO: 178224 - DNA, 2103 bp, Homo sapiens
  Payload ID: 15011
  Gene Symbol:
  Gene Name: RP11-310N16.1
  ENST ID: ENST00000602369
  CDS Start-End: 54-680
actcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttgccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacacttagagacagggttccaccgtgttagccaggatgatgtagatctgctgacctcgtgatccgcccgcctcggcctcccaaagtgctgagattacaggccttgaaaatattcaggatatccagttactggccactatctgtcccctgataccaagaagttggacacagaactataccttctctgatacagtagttgcttgaagagaccatggattcaattgtggaacactagtttgtattactgaaggctggccaagctgttgaaatacttgctgaattggatgctgaagaatacctgctcttccagaagtctctgtcaccataattggtacattgactttataaaggtgaccttaaaaaggagaaagcaaaattgaaacaaacttcaaaaagaagcctacaagaagtacatcaaagattacataaaatcaatcaaaggccaacatgaagaacagagacctaaacagtaaaaccttttatgacagaagctgtagaacaaaccaagcacatcttactaatttcaacaactaccagttttttaccagtaaaaacatgaatccagatggcatagttgctctaccatgaggatggtgtgaccctgtatatgattttctttaaagatggtttagaaatggaaaaatgttaaccaattggcaattactttggctctatcacctgtcatcacaactgcttgctgcctatcacccacatgacacaatgacttaagataaattggactgatgtcaacttgagctcttcatttatttcgaccattatatctttggagtggaagcattgtttttaagaaaaacaggtcggctggcgtggtggctcacgcctgtaatcccagcactttgggaggccaaggctggtggatcacaaggttgggagttggagactaacctggccaatatggtgaaacaccatctctactaaaaataaaaaaattagctgggcatggtggtgcatgcctgtaatcccagctactcaggaggctgaggcaggagaatcgcttgaaccagggagtcggaggttgcagtgaaccgagatcacgccactgcactccagcctagtgacagagtaagactctgtcaaaaaaaaaaaacaaaaaacttgtcaagtaggttgtctaaaaataaaatgcacttaaactcatttgaaagaatcctttttagtttaatatatgtttatgctaaatccatccta

SEQ ID NO: 178225 - DNA, 573 bp, Homo sapiens
  Payload ID: 15012
  Gene Symbol:
  Gene Name: RP11-314N13.10
  ENST ID: ENST00000617804
  CDS Start-End: 99-449
gcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccggctgtgggcagttctggccaagttgctcacgaataagctccacctttctcttccaaatcatggaaacatggagggatccctctattgagggaaatgactttcactggaaagaggaaaagggtgttctgagaatcagccatgtcatccctgtacccatctctagaggacctaaaagtggaccaagccattcaggcccaggtcagagcctcacccaagatgccagccctgccagtccaggcaacagccatttccccaccaccaggtgagtgggctgggatgaggggctcctgggtgccaagtcctttcagggaagagatcatcagggaagcttggcaatgccaaagttttgtacccaaacttggcagaactggaaaattatatgggtctttc

SEQ ID NO: 178226 - DNA, 718 bp, Homo sapiens
  Payload ID: 15013
  Gene Symbol:
  Gene Name: RP11-315D16.2
  ENST ID: ENST00000562767
  CDS Start-End: 135-413
cgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaac

SEQ ID NO: 178227 - DNA, 479 bp, Homo sapiens
  Payload ID: 15014
  Gene Symbol:
  Gene Name: RP11-318A15.7
  ENST ID: ENST00000587459
  CDS Start-End: 1-303
attggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatcataatgcagtccagaaatgaaaataaacgttcat

SEQ ID NO: 178228 - DNA, 835 bp, Homo sapiens
  Payload ID: 15015
  Gene Symbol:
  Gene Name: RP11-321N4.5
  ENST ID: ENST00000503906
  CDS Start-End: 1-293
attattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggggaaaaggggtcgaggccggtcctgacctgttacaatgaagactgacttgctatgtgggattacaccagaagcttgcagtggagtaatggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaa

SEQ ID NO: 178229 - DNA, 455 bp, Homo sapiens
  Payload ID: 15016
  Gene Symbol:
  Gene Name: RP11-322E11.6
  ENST ID: ENST00000589258
  CDS Start-End: 67-438
ggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcaggtgcctggacttggagaaccaggaggtgaggggactgactacttgaagatcacatggaggaggagtctgatccaggcccaggcaccaaggaaaggccatgcaaggacacagggagaagggcagctgtctgtaagccagaaagagccttcactagaaaccaaatcagccagaaccttcatcttggactttccagccttcagagatgtgaaaaaataaatttctgttgattaacc

SEQ ID NO: 178230 - DNA, 395 bp, Homo sapiens
  Payload ID: 15017
  Gene Symbol:
  Gene Name: RP11-322N21.2
  ENST ID: ENST00000506599
  CDS Start-End: 8-295
tgtgcccatggggccatctcggcttgtccgtggccctcggccccagggcatgcgttccccctaccgcaggccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacactgacaccaccatagtgtggatcttcccacctcaagttctcagacatctcaggcaacctgggatttttctgatcctctagaagtgcccagaagctagcccagaagcttggtttgccctggacctgcatctcctaggggccgtgtgggtggtgaacaacaaatacagtcattctgctcaaa

SEQ ID NO: 178231 - DNA, 3695 bp, Homo sapiens
  Payload ID: 15018
  Gene Symbol:
  Gene Name: RP11-330H6.5
  ENST ID: ENST00000494383
  CDS Start-End: 1-3559
ctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggct

SEQ ID NO: 178232 - DNA, 570 bp, Homo sapiens
  Payload ID: 15018
  Gene Symbol:
  Gene Name: RP11-330H6.5
  ENST ID: ENST00000478201
  CDS Start-End: 1-167
actccatgccggggtacaagtgcagcatcaaggagcgaatgctctactccagctgcaagagccgcctcctcgactccgtggagcaggacttccatctggagatcgccaagaaaccgctgctgcccctgtgggaagggacctcgagtgtgaagcatccttccctgtagctgctgtccagtctgcccgccagaccctctggagaagcccctgccccccagcatggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctac

SEQ ID NO: 178233 - DNA, 2745 bp, Homo sapiens
  Payload ID: 15019
  Gene Symbol:
  Gene Name: RP11-33O4.2
  ENST ID: ENST00000318673
  CDS Start-End: 4-315
agcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgggtatctggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctgtacgtgagtcctgagaggcgtgggatggtgcccagtgggggtgtatggggggactaggggagggcagaactgctggtcctatcagattcagcagcgactggaatagggacatattttatatttggaatccaagacttttccttgattcatctggtctccttgaatttcacactgttttctgctgtcccccaaggtcacttcctattccttccatgggagtttccttctctgggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtc

SEQ ID NO: 178234 - DNA, 1284 bp, Homo sapiens
  Payload ID: 15020
  Gene Symbol:
  Gene Name: RP11-343C2.11
  ENST ID: ENST00000570054
  CDS Start-End: 1-1284
ttgtaccgctacccctttgaaaggctgaagatgtctgctgatgatggcatccgaaatctatacttggattttggtggtcccgagggagaactgaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatg

SEQ ID NO: 178235 - DNA, 887 bp, Homo sapiens
  Payload ID: 15021
  Gene Symbol:
  Gene Name: RP11-343C2.12
  ENST ID: ENST00000562949
  CDS Start-End: 1-495
tccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaa

SEQ ID NO: 178236 - DNA, 722 bp, Homo sapiens
  Payload ID: 15022
  Gene Symbol:
  Gene Name: RP11-343C2.7
  ENST ID: ENST00000564737
  CDS Start-End: 1-517
tgggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttacgaggttcagcggacagtggggatgtcacatgaccggcatgttgctgccacggcacataacccacagggatttctcatagacacctcccagggtgttcggggccagattaacttctctacccaagagacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccag

SEQ ID NO: 178237 - DNA, 597 bp, Homo sapiens
  Payload ID: 15022
  Gene Symbol:
  Gene Name: RP11-343C2.7
  ENST ID: ENST00000570293
  CDS Start-End: 1-327
gggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttacgaggttcagcggacagtggggatgtcacatgaccggcatgttgctgccacggcacataacccacagggatttctcatagacacctcccagggtgttcggggccagattaacttctctacccaagagacaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaaca

SEQ ID NO: 178238 - DNA, 564 bp, Homo sapiens
  Payload ID: 15023
  Gene Symbol:
  Gene Name: RP11-343C2.9
  ENST ID: ENST00000563634
  CDS Start-End: 97-564
aaatttaaatccctggtaatctgtagaaccttctcctaggaaatggtgaagtctattaggagccacttgtgactccatgacctgttaaaaccagcaatgaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccat

SEQ ID NO: 178239 - DNA, 397 bp, Homo sapiens
  Payload ID: 15024
  Gene Symbol:
  Gene Name: RP11-345J4.3
  ENST ID: ENST00000549858
  CDS Start-End: 1-397
ccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaaggtggctgcccgggtgaaggccgtggatggggatgagcagtggatcctggccgaggtggtcagttacagccatgccaccaacaa

SEQ ID NO: 178240 - DNA, 523 bp, Homo sapiens
  Payload ID: 15024
  Gene Symbol:
  Gene Name: RP11-345J4.3
  ENST ID: ENST00000551411
  CDS Start-End: 1-432
cggccgcggcggatgggaagccgtgcacgacgagcacaatctccatggggaggacaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagagactacgtggccagacctggagacaaggtggctgcccgggtgaaggccgtggatggggatgagcagtggatcctggccgaggtggtcagttacagccatgccaccaacaagtgagtgacaccagccccggggctgctctctgcccttcctgtc

SEQ ID NO: 178241 - DNA, 1693 bp, Homo sapiens
  Payload ID: 15024
  Gene Symbol:
  Gene Name: RP11-345J4.3
  ENST ID: ENST00000549950
  CDS Start-End: 120-1439
tgaatctctgcagggcaagccctttactcactcacagtagaggccaggaccatcgtctgttattttattaactgtttcttggccattggctctatgtgggactttgttctacagcagtgatgagagctgcccccaggcagtttagtacacagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcggacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggacaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 178242 - DNA, 3103 bp, Homo sapiens
  Payload ID: 15025
  Gene Symbol:
  Gene Name: RP11-345J4.5
  ENST ID: ENST00000565417
  CDS Start-End: 1-268
ttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgtttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaa

SEQ ID NO: 178243 - DNA, 1305 bp, Homo sapiens
  Payload ID: 15025
  Gene Symbol:
  Gene Name: RP11-345J4.5
  ENST ID: ENST00000568556
  CDS Start-End: 201-575
tgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatg

SEQ ID NO: 178244 - DNA, 937 bp, Homo sapiens
  Payload ID: 15025
  Gene Symbol:
  Gene Name: RP11-345J4.5
  ENST ID: ENST00000569622
  CDS Start-End: 1-748
ggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttg

SEQ ID NO: 178245 - DNA, 502 bp, Homo sapiens
  Payload ID: 15026
  Gene Symbol:
  Gene Name: RP11-347C12.3
  ENST ID: ENST00000549390
  CDS Start-End: 1-432
cggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagagactacgtggccagacctggagacaaggtggctgcccgggtgaaggccgtggatggggatgagcagtggatcctggccgaggtggtcagttacagccatgccaccaacaagtgagtgacaccagccccgggg

SEQ ID NO: 178246 - DNA, 1693 bp, Homo sapiens
  Payload ID: 15026
  Gene Symbol:
  Gene Name: RP11-347C12.3
  ENST ID: ENST00000550538
  CDS Start-End: 120-1439
tgaatctctgcagggcaagccctttactcactcacagtagaggccaggaccatcgtctgttattttattaactgtttcttggccattggctctatgtgggactttgttctacagcagtgatgagagctgcccccaggcagtttagtacacagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcggacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 178247 - DNA, 569 bp, Homo sapiens
  Payload ID: 15026
  Gene Symbol:
  Gene Name: RP11-347C12.3
  ENST ID: ENST00000568353
  CDS Start-End: 1-464
ccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaaggtggctgcccgggtgaaggccgtggatggggatgagcagtggatcctggccgaggtggtcagttacagccatgccaccaacaaacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctcca

SEQ ID NO: 178248 - DNA, 460 bp, Homo sapiens
  Payload ID: 15027
  Gene Symbol:
  Gene Name: RP11-350O14.18
  ENST ID: ENST00000568665
  CDS Start-End: 1-101
ccttgggcctcacatatttgtcccttctgctcatccctgctgcaggtgcctcctcctgcccccgcactccactcccagccatggctccccttccccagtgaaacatgcccgagacaagtggacaacagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctga

SEQ ID NO: 178249 - DNA, 543 bp, Homo sapiens
  Payload ID: 15028
  Gene Symbol:
  Gene Name: RP11-371E8.4
  ENST ID: ENST00000554824
  CDS Start-End: 77-349
aagctccgactgcggcggcatccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctgaaatctgaaagtttcctagcaacctcatctttccactacatctgactgaacccgaaaggaaggctgagtattccatagcaagctgttacttaaaagataaagcagggctcagtaaagagacaagcactatatgcctgtagtacctgcaccccagagggagaagaaccagcaggaatttgtttagcttgcagttatgaatgtcatggaagtcacaaactatttgagctatacacaaaaag

SEQ ID NO: 178250 - DNA, 554 bp, Homo sapiens
  Payload ID: 15028
  Gene Symbol:
  Gene Name: RP11-371E8.4
  ENST ID: ENST00000557574
  CDS Start-End: 57-554
tccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttggggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgag

SEQ ID NO: 178251 - DNA, 543 bp, Homo sapiens; identical to SEQ ID NO: 178249
  Payload ID: 15028
  Gene Symbol:
  Gene Name: RP11-371E8.4
  ENST ID: ENST00000627287
  CDS Start-End: 77-349

SEQ ID NO: 178252 - DNA, 554 bp, Homo sapiens; identical to SEQ ID NO: 178250
  Payload ID: 15028
  Gene Symbol:
  Gene Name: RP11-371E8.4
  ENST ID: ENST00000625267
  CDS Start-End: 57-554

SEQ ID NO: 178253 - DNA, 5514 bp, Homo sapiens
  Payload ID: 15029
  Gene Symbol:
  Gene Name: RP11-385D13.1
  ENST ID: ENST00000455584
  CDS Start-End: 45-2906
gccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacagggtgctgctgcgttttcgcaggccatctttagggactggcttctgtcttgtgtccttgagtgacctactccctggtttccccccatctctgcagccactgcctccattccaggggccaccactccagccccagatgaaagatggaagaaaagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttccttggggcagcatctaaccctgaggaaccatggaggaattcactccggtgtatatccgaaatgaataggctgttttctggaaaagcagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagaggaattgatcctaattatgccaataaggtttctatcccagttcctaaaatggtagatgacgggaagagcatgcgtgtgaaacatccgaagtggaagttgagaacgaagaatgagtacaacctgtggactgcataccagaacgaggaaacgcagcaggtcctgatggaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaactagaactaaataaccaaagtaaatgcttggcacactctcaaggaagcacagctctgccttgcaccagtgccagaagcctctagaacagtgacggaggcaaccagatgaagaagacgagacattcctctcccagcagcgtgagagacacctggcgactgctggcaggaatcagcatttcacacaagcaatcaacataactaaaacttaagtactgtcctctgtattctccttgggaaaatgaaacaaatgacaatgtcattgcattgattttgttctcattaaatggtattttagctataaacattttcccctttgatttgcaaaaaaaaattatagaaaatgtctatgttgcttaaaatgcaaagggtttttactgtaactatttcaaaaacagccaattatcttactattccttgtttattacatatattcaaggtcactttctccatcatttgaaacaacatagacaaaagggagctcagtaacaaacaggcaagcagcaccaagactggcactcaaagctgtattaggaccagatgcattttcaatttcttgaaacagtggagctgcagtttattcagtttatttaggtcagccctaaggtgaaactatattacattcaaaattatcctttaaaatcccctgaactcatccataaagtacatggaaggttatgtatgtacaattctggaaaataatgactgtgttcactagagtttgagaatcactcagttaaattaagagggaacaaaagaaaagcctatatttagatggctgggcattcaaaccattccgcctttaaggagactctcagtagaggagaggtggagaattctatggggttctgtttccctgtggggtttactctattattcttcatgctacaagcatcggcagcctggctaaacagaaatgtatttctgttggtgctggctgtgaggatttgactgaacaggggagctgcaccttctctgggattacattctaatgtcacctctgctcctctcccttataatgaattacaggtagacagagctatagcactgtaacaaaggtgaagatacacataggcaatagagacgggaacgtttcagagaagagtaggcaatggtagccagcctgaattttgagctgagtaacagaagaacttcacttctgctgtgaccaccctggtccaagctatcatcaagtcatgccaggagctgccccaagtctctctcctgggattctatggtctattttacccaggcagctgaggggttcttttaacctaaatctgatcacaccagccccatttgtacaacttatttctggcttctcccactgcacatggagttccagcccttctgtcttcatcttgtgccaccctgccccttgttcattatgttctcaccacactggcctttctatttatagtgtcaggtagaagcccactctggccaccgtacgttcccccagatctctgcatcactctccttcagttctcaactccaatccactccctcccagtgccttcccgctctggagtgctctctcccaattgttctgtattatcattctgtctctttccttggcaccattgatgcccacctagaatgatcttttagagctcaactgttcactggctaaagttctaccttccccaccggacgggaatgaaggcagggatcaggtcatgctggtcatattccagcatttagcacagagtgtaacatccagagatgctgaggacacaattctgaaaaaagtagtaacaatgatgacagcagtatcatttactgacggctttataagaacagtcgttttctcacataactctatgaggtggaaggcacgaacctcattttataggcgaggaaacagagcctcagagaagtttagtaatatggtcagggttgcatggtgaagcaggcggaggagctaggctttgattccaggcaatcggaccccaaaatcttatgttctacaacattctattccccaaggaaaaaccaagtgctctgaaaatctagtctaaaacagactataattttcaatacacaaatttacccattgcaagtgtacagttagttctgagttaaaaaaaaaaaaaaaggtaaacatagtgtaaccaccaccacaatcaagatatggaacatataaatttatcttttcaaaaagtttcttatgcccctctgtagccaattccctcctgtcccccgcacccctccccccaccgccgtttcccagtaaccactgatcttacttctgtgcctagttttggctttccaaaatgtcatataaatggaatcatacgacatgctgtcttttgtctctgtcttctttcacttaacatagtgcttttgaaacacacccgtgtcactgcacgtaccagtggtttgttccttttaatttctgagtagtatttcagccgtaatttgtttatctattcatcagctgagggatgtttaggttgtctttagtgatatttaagctaatattcatgtacagatctttgtatggacatgtgtccatacatacacaggaatgggattgtatggtaaattttgtttaaatttattgaaatctgccaaactgttcttggaattgattgtaccattctgcattcacactagcaataaacgagagcttcaggtattctacacccttgtcagcactgtattgttgtttttaataaatgttaattatgct

SEQ ID NO: 178254 - DNA, 1391 bp, Homo sapiens
  Payload ID: 15030
  Gene Symbol:
  Gene Name: RP11-385J1.3
  ENST ID: ENST00000614557
  CDS Start-End: 321-1028
atctgtgagctatccatgctaacatggggaaggtttcagaggaggagcccttccttcccttcgttgccattagcacaggtctccagggcacgtcttttctcctgggtttctatgtttgttttactcactgcctctcgttcctctgcttacgacattttcatgaataagccagaagatagtcagcacagaagcctccctacaacctggaaaaagaaatgagctttcactttgaatatcacacagacatactgaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttga

SEQ ID NO: 178255 - DNA, 566 bp, Homo sapiens
  Payload ID: 15031
  Gene Symbol:
  Gene Name: RP1-138B7.6
  ENST ID: ENST00000621802
  CDS Start-End: 1-228
caccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgac

SEQ ID NO: 178256 - DNA, 669 bp, Homo sapiens
  Payload ID: 15032
  Gene Symbol:
  Gene Name: RP11-38C17.1
  ENST ID: ENST00000410042
  CDS Start-End: 208-603
gcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccagcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaa

SEQ ID NO: 178257 - DNA, 647 bp, Homo sapiens
  Payload ID: 15033
  Gene Symbol:
  Gene Name: RP1-139D8.6
  ENST ID: ENST00000372963
  CDS Start-End: 95-478
acctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagca

SEQ ID NO: 178258 - DNA, 580 bp, Homo sapiens
  Payload ID: 15033
  Gene Symbol:
  Gene Name: RP1-139D8.6
  ENST ID: ENST00000623004
  CDS Start-End: 52-390
ccctgaccaccagaagttccacctcaccatcaagaaaggccctggtccaggatgtgcaaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagcagttaaagtttgtccttccttt

SEQ ID NO: 178259 - DNA, 2395 bp, Homo sapiens
  Payload ID: 15034
  Gene Symbol:
  Gene Name: RP11-400G3.5
  ENST ID: ENST00000464755
  CDS Start-End: 1-1005
aaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcagctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcattggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcac

SEQ ID NO: 178260 - DNA, 701 bp, Homo sapiens
  Payload ID: 15035
  Gene Symbol:
  Gene Name: RP11-403P17.5
  ENST ID: ENST00000561728
  CDS Start-End: 1-220
caatcctgagacttgttaccagaggttaaagaagagatgcagggaagaggagaaggtcattccgctggaatacctggaagcaattcaccatctccatgaggagtggctcatcaaaggcagccttttccccatggcagcccctgttctgcgctctctacagaggcacaacaaacaggccgggaggagggacgggaggccaggagagctccacgttccgtgaaacctttgcagggggaagttgatcccacagccacggaaatagccagatactcctctggccttccctcccaccctgagggagacacccggaggagcagatccccagggaattcagaacagctgccacggaacctcccctgaaactgcaggggcattcccggcatgcctactcaacagcctgaggagggcaccagctgagagacagaatttttggaagaacttaggaaagaaactaagaaaagacaacagcacacagcaacaagcagtcatccgggcctctcatgtcaccgagaacattatggtgggcgcctgtgagctcttcctgaccacccaagacttctaggatgctttcccgaccaccctgctccacccagggcagagttgccaactccttgatgcctcctgtgttgcaatcccagtcagatgaggtcccagggccccagggtgggcggcggctcaccgtagccgtgctcgtactctcg

SEQ ID NO: 178261 - DNA, 600 bp, Homo sapiens
  Payload ID: 15036
  Gene Symbol:
  Gene Name: RP11-404P21.8
  ENST ID: ENST00000553811
  CDS Start-End: 151-378
agctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcagggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctg

SEQ ID NO: 178262 - DNA, 4392 bp, Homo sapiens
  Payload ID: 15037
  Gene Symbol:
  Gene Name: RP11-407N17.3
  ENST ID: ENST00000553728
  CDS Start-End: 214-4233
gacactgcagattgaaaacagacagtgtttgtctctcaagttaaaccaacaagccgatagaaaaaggtagttatcaagagatttttaaaacttcaaccctttttctcttatagttagtgaagagagtagaatatctccagttttggctgacatctctacaacctgaacaattggcttaaacttcacttgggattcccggttgcttgttttagcatggcaaaatttggcgttcacagaatccttcttctggctatttctctgacaaagtgtctggagagtacaaaactgctggcagaccttaaaaaatgtggtgacttggaatgtgaagctttaataaacagagtctcagccatgagagattatagaggacctgactgccgatacctgaacttcactaagggagaagagatatctgtttatgttaaacttgcaggagaaagggaagatttgtgggcaggaagtaaaggaaaggagtttggatattttcccagagatgcagtccagattgaagaggtgttcatatctgaggaaattcagatgtcaacgaaagaatctgactttctttgtcttcttggagtaagttacacatttgacaatgaagatagtgaattaaacggtgattatggtgaaaatatatatccttatgaagaagataaagatgaaaaatctagtatatatgaaagtgattttcagatagaacctggattttatgcaacttatgaaagtactttgtttgaagaccaagttccagcattagaggctcctgaagatatcggaagtaccagtgaatcaaaagactgggaagaagtagttgttgaaagtatggaacaggatcgtattccagaagtgcatgtcccaccatcttcagctgtgtctggagtcaaagaatggtttggattgggaggagaacaagctgaagagaaggcttttgaatcagttattgaacctgtacaagaaagctcatttcggagtagaaaaatagcagtggaagatgagaatgacctagaggaattaaataatggtgagcctcaaacagaacatcagcaagaatctgaatcagaaattgattcagtgccaaagacacagtctgaactagcatctgagtcagagcacattcccaaacctcaatccactggttggtttggtggaggatttacaagttatttaggttttggagatgaggatacagggcttgaattaatagctgaagaaagcaatccaccactacaagattttcccaattccatatcatctgataaagaagccacagttccatgtacagaaatattaacagaaaaaaaagacacaatcactaatgatagcttgagtctcaagccaagttggtttgattttggttttgctatactaggctttgcatatgccaaggaagataaaattatgttagatgacaggaaaaatgaagaagatggtggggcagatgaacatgaacatcctctaacaagtgaattagaccctgaaaaagaacaagaaatagaaacgataaaaattatagaaacagaagatcaaatagacaagaaaccagtctcagaaaaaacagacgaatctgatactataccatatttgaaaaagttcttgtataattttgacaacccttggaacttccagaacattccaaaggaaacagaattgccatttcccaaacagatactggatcaaaataatgtaattgaaaatgaagaaactggagaattttccattgataattatcccacagataatacaaaagttatgatattcaaaagttcatacagtctgtcagaagatgcttctgagtttcagattctgaaatacttattccaaattgatgtttatgatttcatgaattctgcattttcaccaattgtaattcttacagaaagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaa

SEQ ID NO: 178263 - DNA, 1044 bp, Homo sapiens
  Payload ID: 15038
  Gene Symbol:
  Gene Name: RP11-407P15.2
  ENST ID: ENST00000561882
  CDS Start-End: 1-1044
atggttcaagcatctgggcacaggcggtccacccgtggctccaaaatggtctcctggtccgtgatagcaaagatccaggaaatatggtgcgaggaagatgagaggaagatggtgcgagagttcttggccgagttcatgagcacatatgtcatgatggtattcggccttggttctgtggcccatatggttctaaataaaacatatgggagctaccttggtgtcaacttgggttttggcttcggggtcaccatgggagtccacgtggcaggccgcatctctggagcccacatgaatgcagctgtgaccttcactaactgtgcgctgggccgcgtgccctggaggaagtttccagtccatgtgctggggcagttcctgggctccttcctggcagctgccaccatctacatctgtgtctccgcagcggccattctccacttttcgggtggagagctgatggtgaccggtccctttgctacagctggcatttttgccacctaccttcctgatcacatgacattgtggcggggcttcctgaatgaggagtggctgaccaggatgctccagctgtgtctcttcaccatcacggaccaggagaacaacccagcactgccaggaacacacgcgctggtgataagcatcctcgtggtcatcatcagggtgtcccatggcataaacacaggatatgccatcaatccatcccgggacccgccccccagcatcttcaccttcattgctggctggggcaaacaggtcttcagcgatggggagaactggtggtgggtgccagtggtggcaccacttctgggtgcctctctaggtggcatcatctacctggtcttcattggctccaccatcccacgggagcccctgaaattggaggactctgtggcgtatgaagaccacgggataaccgtattgcccaagatgggatctcatgaacccatgatctctcccctcaccctcatctccgtgagccttgccaacagatcttcagtccactctgccccacccttacatgaatccatggccctagagcacttctaa

SEQ ID NO: 178264 - DNA, 1423 bp, Homo sapiens
  Payload ID: 15039
  Gene Symbol:
  Gene Name: RP11-411B6.6
  ENST ID: ENST00000527595
  CDS Start-End: 21-344
gaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttca

SEQ ID NO: 178265 - DNA, 1952 bp, Homo sapiens
  Payload ID: 15039
  Gene Symbol:
  Gene Name: RP11-411B6.6
  ENST ID: ENST00000529568
  CDS Start-End: 21-500
gaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttcagggaccgtgggacccctttgctgggacagttatttcaagagtatgactcttatctttctctcttctatagatccattttgtgccacactccattgtagactttgaatgtagtagtctttccaagagcctacttgcatgggagtcccaccctcgctaccactcacttccccatcccct

SEQ ID NO: 178266 - DNA, 538 bp, Homo sapiens
  Payload ID: 15039
  Gene Symbol:
  Gene Name: RP11-411B6.6
  ENST ID: ENST00000528174
  CDS Start-End: 27-242
agaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtgagacagagagggtatggcgactacccgaagctccctgaccgctcacagcatgagagagatccatggtatagctgggaccagccgggcctgaggttgaactggggtgaaccggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacaca

SEQ ID NO: 178267 - DNA, 582 bp, Homo sapiens
  Payload ID: 15039
  Gene Symbol:
  Gene Name: RP11-411B6.6
  ENST ID: ENST00000533549
  CDS Start-End: 14-229
gaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtgagacagagagggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtggatagaccatgaagctgaaggaacttgagcggccagctgtccaggcatggagcccagccagccaataccctttgtatctggccacag

SEQ ID NO: 178268 - DNA, 1234 bp, Homo sapiens
  Payload ID: 15039
  Gene Symbol:
  Gene Name: RP11-411B6.6
  ENST ID: ENST00000557395
  CDS Start-End: 31-549
gtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaa

SEQ ID NO: 178269 - DNA, 744 bp, Homo sapiens
  Payload ID: 15040
  Gene Symbol:
  Gene Name: RP11-426L16.10
  ENST ID: ENST00000605933
  CDS Start-End: 1-744
tgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccc

SEQ ID NO: 178270 - DNA, 680 bp, Homo sapiens
  Payload ID: 15040
  Gene Symbol:
  Gene Name: RP11-426L16.10
  ENST ID: ENST00000606954
  CDS Start-End: 1-100
tgaattcacccaccttgagttcccccgcagagttctgcccaaggagctggggcagaggatgttgtaccgggaccagaacatgaccggctggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccc

SEQ ID NO: 178271 - DNA, 813 bp, Homo sapiens
  Payload ID: 15040
  Gene Symbol:
  Gene Name: RP11-426L16.10
  ENST ID: ENST00000606505
  CDS Start-End: 1-813
tgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccc

SEQ ID NO: 178272 - DNA, 3360 bp, Homo sapiens
  Payload ID: 15041
  Gene Symbol:
  Gene Name: RP11-432B6.3
  ENST ID: ENST00000483754
  CDS Start-End: 187-3033
agcccttcggggcagaggagggcggggactcggggcggctctcagcatccgcctggagctcgtggcgctgtgtttccgtgctgtggagttgcctggtccgcttcctccccgcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaaggggcgtgtcacagaacaggaaactgatacaatgacacttgtttcttaagagaagctgattgaatcctgtagcacattactgcacaattaatggctttaaacgagttacaagtcgtaagttcttatgttttggatcatgttgtggaatgtattccaaatgaaaaatggaggagaaagtgcacaacatcatatgcttcatggtatggcatatacatgtcaattatttttacatataactgtgatgaatgatacaattaaaagctatactaca

SEQ ID NO: 178273 - DNA, 653 bp, Homo sapiens
  Payload ID: 15042
  Gene Symbol:
  Gene Name: RP11-434D12.1
  ENST ID: ENST00000608606
  CDS Start-End: 1-400
gggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggctttttttaggcttctgtcaccacaaaatgttacttggaaaactagatcccagcagatgacctgtacttctctgctctctcccctactgcaaagaggcagtgagggcagcattagtaagcctgactcaggggaaggtaagtggcctgcagagaaatggtcctaggtccgcaaccgaggcgagtgaacttgtcggacagatgaagactctaactggaagaaacgatcagcgcattcacggatgcaccaccatccagaaatctcccggtggcttccatacaaaaactgatgtttctaaagatggaaagaacaggtctaggaggcagaagagtatctcctagcaaagtgttctgtagctcaaagggcagtcaggagcacgtctttgaattcctcgcagacgatgtatccatcagtcctgt

SEQ ID NO: 178274 - DNA, 1721 bp, Homo sapiens
  Payload ID: 15043
  Gene Symbol:
  Gene Name: RP11-435I10.4
  ENST ID: ENST00000568224
  CDS Start-End: 337-1419
cctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgagtatactaactttctgtagaggtatacttgtaatcacaaataagaataaattatataaaacaa

SEQ ID NO: 178275 - DNA, 808 bp, Homo sapiens
  Payload ID: 15044
  Gene Symbol:
  Gene Name: RP11-437B10.1
  ENST ID: ENST00000629685
  CDS Start-End: 428-808
agagcccgcgggcggcaggtgggcggggggcagcctcgtcgccgggactggatccgccgggaaaggggcggcgggtgaatgccggcgagagcccgaaggggatcgggcgtggagagcccctttctgtcctggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttataaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagag

SEQ ID NO: 178276 - DNA, 2831 bp, Homo sapiens
  Payload ID: 15045
  Gene Symbol:
  Gene Name: RP11-438J1.1
  ENST ID: ENST00000450534
  CDS Start-End: 1-336
cagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggagcatacagtttgaacatttattcgcctcctgagcttgtacaacagtcgtg

SEQ ID NO: 178277 - DNA, 2270 bp, Homo sapiens
  Payload ID: 15045
  Gene Symbol:
  Gene Name: RP11-438J1.1
  ENST ID: ENST00000437082
  CDS Start-End: 1-1998
cagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggcagtgcaaagccctaccctgtagagggtagtccaaggaagcgtgggaccctgctcacccagagcccccatgactaggactctccctgcacctgcaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagcatacagtttgaacatttattcgcctcctgagcttgtacaacagtcgtg

SEQ ID NO: 178278 - DNA, 3513 bp, Homo sapiens
  Payload ID: 15046
  Gene Symbol:
  Gene Name: RP11-444E17.6
  ENST ID: ENST00000505802
  CDS Start-End: 1-406
gcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtaccaggctgcctaggaagccaggtggtgcctttaagatctccatggagaaacgcacagctcgacgcaggatccgacgaagaaccagcctaaaggggttcagagcccagacatgaatccccagcggctcatgcccttccagactcacgggggacctgacatcccagggaagatgccatcagagatgcagacactgagtgtgcggatgtggtcagccaccacgcggtacgctgtgtctgtgcgcccctcgtctgccacccctactcggcccaagtaagggggtgccctgcagccctgggaagcagaagagtcagccagtggccctgcctgacctggcccaggtgggtgctctttatcgcctctagagcatctgccctcagccctaaagccaaccacatccagaatggccttgccagtccagtcctgggctgagaagcctcacagatgagcacaagccaggccctgccctcacggggctcatatttggtgctacaagtgaacatatctgtgaccatttactgaatttctactatcagaactgggtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgacccttatgaggaagtgttgtgctttgcttttttaaaactttatattttgaaaactttcacatttacataaaagttgcaagaattgtacaacaaacacctgcatatccttcacatagattctatcattgttaatatttgttcaaactttctctctctcacaatattacagttaccattttgctgaactctttgagagtgagtggcagatattgtaaccctttacacctgtatacctacatacctcagcatgtatcttctaaggtcaaggatgttgtctaacaaccacaacacaaataccaaactcacagaatttaacactgataaaatattattaacatttagtccacattcaattttagtcaattatatttagttttctaaggatgccctcaaatcaatcataaaatacagacatgatgtgagtgtcttagcctgttcaggctgctataacaaaacgccataaacagaatggcttataaacaataggaattcatttcttacagttctggaggctgggaagtccaagcgcagggtgctggcaggttcagtgtctgctgagggccagccttctggctcatagatagtaccttcttgctgtgtcctcatatgatagaaagggtgagctagtcctctggggtctcttttacaagggcactaatctcattcatgagggctctggtctcatgacctaatcgcctcccaatggccttacctcctaataccatcaccttggggattaggtttcgacatatgcattttggggtggggaggacaaacatttagaccatagcagtgaactttcattgcttttggtaaaacttttcattttattaataccttttggaatgtttctctaatgttaacttggtacatgtcagaaaaacatgaaggctggatctataccaggtaagtaatactattgccctgtagctgcattccccagtttagtattgcctatctacaatagccaagcagggtgagagctcagtgaccaccagtcatgagttttagggcctcctgtcaatcagacaagaagcaaacatttggaggaaaaggtgaaaacaaaagctgcctcacaggctttgacacagtcaaactagtgactcacggcatttttacagccaatctctttctccactagggaacccccttggctggctaatgaaggctgcagatctagtatctccaaaaccttaaagtggaaagagattggggtccatgctgagactccacatgtctatgacatgagcatgatttatttcccaaaatgtttgttgtctccagtcacagccaaagtgaatgaagcaggtttagaacacgatacatttagccaggtgtggtggctcatgcctgtaatcccagcacttttggaggccgaggcaggcgaatcacttgaggtcaggagttcgagaccagcctggtcaacatggcgaaacctgtctctactaaaatcacaaaaattagccaggcaagatggtgggcacctgtaatccctggtactcgggaggctgaggcaggagaatctcttgaacccaggaggcagaggttgcagtgagccaagaccatgccattgcactccagcctgggcgacaagagcgaaactccatcccaaaaacaaagaagcaaacaaaaaccacaatgcattcatggcaccttcatatgtgcctctagactaactggcagagagcatggtgccgactgccagctgctgtgcctgaccactccttgggttaacatcagcatacatccgtgctaatcctctggcccctgggtcacaggcccacccctgctcccaa

SEQ ID NO: 178279 - DNA, 2382 bp, Homo sapiens
  Payload ID: 15047
  Gene Symbol:
  Gene Name: RP11-446E24.4
  ENST ID: ENST00000311841
  CDS Start-End: 321-533
attttcttataggtgatacctgctaagcgctccccgcctacccagagactgggaggaacctggaaaatcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccaggcctgagttccttcccttcctgatagtgtggtcggtgcagatctcagaacgtgtaaacctggtgacaccagatccgtcactttacacctcacctctctttcccttgctccggaccctgagatcctggcctacctgagctcggcagacctgtgggggcccctggtgaggagatgctggcagagtggggggcttgcctgctgctggcagtggcactgctgggcccagggctccaggcccaagccatggaaggtgtcaaatgtgggggtgtgctctcagcaccttctggaaacttctccagccccaacttccctagactgtacccctacaacacagagtgcagctggctgatcgtggtggccgagggatcctcggtgctgctcaccttccatgcctttgacctagagtaccacgacacctgcagcttcgactttctggagatctacaatggggcctcaccagacaagggcaacctgctggggaggttctgcggcaaggtgcccccgccgcccttcacctcctcctggcatgtcatgtctgtcatcttccactcggacaagcatgtggccagccatggcttttctgcgggctaccagaaaggtcaacggggggccttagggacctgttgcagtggctcacacctgtaatcctggtgctttggcaagccaaagtgggaggattacttgatcccaggagttcaaggggggatttggcagtggaggagctggccctggggtggagatgggaagatagcagcagggctcaggtgagacctacagggtctcagcatcttggcacgtaggctgctctgtaacctgcaggacccagctctcatgcatagtttataaggcaaaagcagcctcctcactgttcatgaccatgcttgtagctggggttcccaccttcatggcaatgctccccatgccgcctccgtttctcctagagtcgtcagagggtcgcactgcgctcaggaatgaggctctcatgctctactacccttgtcattcttgtcctgtgtcatggcataaggccacaggagaggacaccactgctgttggggccttctgcagcatcccaccacttcacggcttgggaatccttgcctgagttcccacacgagggtctgggtggagctagtggctgttatatcatgtgtccctaacccctctctccttcaaccaggcttgacacctgcctctcagtctagtgagggagaggaggccttgttcttcttgcctttctctttcactcactcatccttgtctccaggttctgtgcaaaggctcaaatctcctgcttcctcccaatgccagaaccaaagacctcactgatgttaactcaaacagtagacacccacagaggctactggttcccagggtccgccaacagcaatcctgggggactcaggtgggaccccagtcactgctgcatttggaaggatagaattgtagaatgccacaacacaagaaccataggctgatctaatcatagttttggaattttagacccttagatttgtagaatgttaggatatcaaagtcttaataccatcagccacatttcctaacatttttaaaaacaggaatacctttatgtcaaatggaaccttatgttaatcccctatatttaaaaaaaaaaaaaaagataaaggcaataaaaaataaaggcaatgtt

SEQ ID NO: 178280 - DNA, 708 bp, Homo sapiens
  Payload ID: 15048
  Gene Symbol:
  Gene Name: RP11-447L10.1
  ENST ID: ENST00000431391
  CDS Start-End: 71-391
ctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccc

SEQ ID NO: 178281 - DNA, 3311 bp, Homo sapiens
  Payload ID: 15049
  Gene Symbol:
  Gene Name: RP11-449H3.3
  ENST ID: ENST00000506502
  CDS Start-End: 217-3300
actgtctcccgcccacctcagccttcgggctaggttgagtgagggctcttgggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagaggtatttcaggagccagcagaggaagaacgagatggcagaaaaaagaaatatcctagtccccagaagactcgttcagaatctagtgaacgaaggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaatggagttttgctcttgttgcccaggctggagtgcaatggtgcgatctcggctcactgcaacctctgcctccctggttcaagtgattctcctgcctcagcctcccaagcagctgagattacaggagcgcgaagatgatggccatgaactccaagcagcctttcggcatgcacccggtgctgcaagaacccaaattctccagtctgcactctggctccgaggccatgcgccgagtctgtctcccagccccgcaggtacgtagtggagcataat

SEQ ID NO: 178282 - DNA, 3411 bp, Homo sapiens
  Payload ID: 15050
  Gene Symbol:
  Gene Name: RP11-458D21.5
  ENST ID: ENST00000612520
  CDS Start-End: 337-1053
aaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgcttttgacatggatggaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggag

SEQ ID NO: 178283 - DNA, 1693 bp, Homo sapiens
  Payload ID: 15051
  Gene Symbol:
  Gene Name: RP11-45M22.4
  ENST ID: ENST00000427497
  CDS Start-End: 502-789
tcacgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaagtcattccccagcccagcctagctgctcccgagaagacagtgaagggcactgagaagggccaagaaaacttcataaagcaggggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaact

SEQ ID NO: 178284 - DNA, 603 bp, Homo sapiens
  Payload ID: 15052
  Gene Symbol:
  Gene Name: RP11-463C8.4
  ENST ID: ENST00000557752
  CDS Start-End: 104-277
atgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacagcctgacctcgctgatctatggggagcagagcgagaagacatctccctcggagacttccttggagatggaacgcagagacaagggattctgttcctggttcttcaacagcataacaatgaag

SEQ ID NO: 178285 - DNA, 776 bp, Homo sapiens
  Payload ID: 15053
  Gene Symbol:
  Gene Name: RP11-463D19.2
  ENST ID: ENST00000358757
  CDS Start-End: 33-518
ggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagtt

SEQ ID NO: 178286 - DNA, 2740 bp, Homo sapiens
  Payload ID: 15054
  Gene Symbol:
  Gene Name: RP11-468E2.1
  ENST ID: ENST00000530611
  CDS Start-End: 35-2482
gctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttatt

SEQ ID NO: 178287 - DNA, 4351 bp, Homo sapiens
  Payload ID: 15055
  Gene Symbol:
  Gene Name: RP11-468E2.2
  ENST ID: ENST00000561419
  CDS Start-End: 1-431
tcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggcct

SEQ ID NO: 178288 - DNA, 297 bp, Homo sapiens
  Payload ID: 15055
  Gene Symbol:
  Gene Name: RP11-468E2.2
  ENST ID: ENST00000625289
  CDS Start-End: 1-297
atggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagaatggggcttttgctgctaa

SEQ ID NO: 178289 - DNA, 4798 bp, Homo sapiens
  Payload ID: 15056
  Gene Symbol:
  Gene Name: RP11-468E2.4
  ENST ID: ENST00000558468
  CDS Start-End: 1-1644
tcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccaggcttcttggtggtccttcttcctggtgccaccatctaggggcaccagggaaagagcggggtgaacagagctttgctgaaaagggccccctgcaacctagtgcctgaccctccctggactcaggaccaggaaggagttgacaccctggatggtcaagggaggccctccccatccagcagcctggcctgggcttcctccctccctgcctccttttttcctttcatagaatttgactggtatttgaagtcacccaatatgtatcaggtgggcactgtgggggaatgcagatgcacaggtgtacacagcagtccagaggtcccaggcctgactccaggaaactggcctccctggggaagccacggtgtcacccagaggtcagatagaagcaagagtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatccttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaatcagtatctgattttctgggagaagaaggtagcagtggtcacagatagagatgtaaacttaagagtggggcactggggttctcttcctgctgacatctccagcctctttcctctcctctgcccacaggttctggctaagatgctgcctgggccctgtgggtcctgggcctggcactctacagaggtaccctctgggcagataagattagggtgtgggttgggcaccaagccttcagccaggcactatagccaccaacttcacatggtaaagtctgggctccacagttcttgctagaaggccccaacatcgggcctgaggttagttagattggaggtctaaatgaagaggagacacttgagggtgacctgaaactatggtctagaggccctgggacctgagaacagaggagtcagagagaagagttgctgaaactgtacctgctgttactggcacctcttcctccagcacaatttcactgtcaccccagcagggtactcccaaactggattccttgctctatctaagccccataaaagacactctggccggctgggcgcagtggctcacacctataatcccagcactttgggaggccaaggtgggtggatcacttgagatcaggagttcgagaccagcctggccaacacggtgaaacagcgtctcttctaaaaatacaaaaattagccaggcctggtggcgggcacctgtaatctcagctacttgggaggctgaggcaggagaatcgcttgaacccgggaggcggaggttgcagtgagccaagatcgtgctattgtactccagcctgggcaacaagagcgagactctgtctcaagatt

SEQ ID NO: 178290 - DNA, 850 bp, Homo sapiens
  Payload ID: 15057
  Gene Symbol:
  Gene Name: RP11-468E2.6
  ENST ID: ENST00000558325
  CDS Start-End: 1-850
actgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcggaactggaacatggtcggagccaaggacacaggactaacaggaaaggacacagactgctgtcaggacacatactaccacacacccgaggccaggaccctgctgacgtggcagacctccaccctggccccttactgccccccgcccctctcccccacctgccagctgccaacagggctctgccttgtgtctgccacacctgtcactgcctatccttgtccagggggggccccatcagcccctcctcagctgcccagcaaagcaagcagttagtggggaggggagggaacatggagcgggggccggtggtgggggcaggactgggggccggggcccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacat

SEQ ID NO: 178291 - DNA, 2306 bp, Homo sapiens
  Payload ID: 15058
  Gene Symbol:
  Gene Name: RP11-474G23.1
  ENST ID: ENST00000406334
  CDS Start-End: 220-1215
atgtatagacaaatttcctcaagaaaagtgggcactgaacagatgggcctgcgggtgctgcaccggggtgacagcagtcctgatgggccgtgcaattctgtagtggatccaagtcggtacacggatgcacagatacctttgactgcctctcgcaggacttggatttttcctgttttttggtgcggcatccggggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctaggggtgggaagacgggcctcttcgccggcctggcctcctctgtgtccatgcggcccgcatccccgccctctcctgctgcggacagctgttcagcctgtcgtttcttcgcccgtcggccacccttgcgggtgacctgggtaaagccctcctctgccctggcgctctgcgtttccatttcggattccatccccggaaatcttaaagcgctgccggctgaaacacgtgcgcagctgcaccacgcagaagccagcctcagccaaccacccctgcagctccgcccctttcctaaaacgtcacaggccggggacctgcaggatttggggccgtatgtatgtgtgcgaaaggcagtgggtaaaggcgataaacaaattcgtgctgttgtgaaggaacattctgtgcgatcgcaggagcgcatctggcattatccggggataactacagccaacatgccagggcatctggggcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttga

SEQ ID NO: 178292 - DNA, 557 bp, Homo sapiens
  Payload ID: 15059
  Gene Symbol:
  Gene Name: RP11-475E11.9
  ENST ID: ENST00000357393
  CDS Start-End: 11-557
gaacaattcgatgacgaggcccaggaagcacgctgaaaccctgggcggcggcaagctgtgcgacctcttctgcggccggcctgggcaggtgtcttcctcgagaggcaggcaggggatcccggacatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatg

SEQ ID NO: 178293 - DNA, 779 bp, Homo sapiens
  Payload ID: 15060
  Gene Symbol:
  Gene Name: RP11-47I22.4
  ENST ID: ENST00000556347
  CDS Start-End: 1-437
cagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatctggcttctagaagagtgagtctggaaaatactgcccctactttcaaatgggagaaagcctcccttgtactaagtttgcaatcattagaaaactgttgatatacagcaaaagaaactaccatcagagtgaacaggcaacctacagaatgggagaaaatttttgcaatctactcatctgacaaagggctaatagccagaatctacaaagaactcaaacaaatttacaagaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaa

SEQ ID NO: 178294 - DNA, 246 bp, Homo sapiens
  Payload ID: 15061
  Gene Symbol:
  Gene Name: RP11-484M3.5
  ENST ID: ENST00000490594
  CDS Start-End: 43-246
gaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatcttgttgcggcattgccctgactgcggagtgcatc

SEQ ID NO: 178295 - DNA, 561 bp, Homo sapiens
  Payload ID: 15062
  Gene Symbol:
  Gene Name: RP11-49K24.6
  ENST ID: ENST00000588705
  CDS Start-End: 5-253
ggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttgtgaattaactgaattgctgacatacatccagaagactcatgagcaccttttatttcatgacttcagttacttctaaaactatggagcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaa

SEQ ID NO: 178296 - DNA, 254 bp, Homo sapiens
  Payload ID: 15062
  Gene Symbol:
  Gene Name: RP11-49K24.6
  ENST ID: ENST00000602459
  CDS Start-End: 4-126
gccatggcctttaccctgtactcactgctgcaggcagccctgctctgcgtcaacgccatcgcagtgctgcacgaggagcgattcctcaagaacaggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaa

SEQ ID NO: 178297 - DNA, 291 bp, Homo sapiens
  Payload ID: 15062
  Gene Symbol:
  Gene Name: RP11-49K24.6
  ENST ID: ENST00000602926
  CDS Start-End: 4-126
gccatggcctttaccctgtactcactgctgcaggcagccctgctctgcgtcaacgccatcgcagtgctgcacgaggagcgattcctcaagaacaggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaa

SEQ ID NO: 178298 - DNA, 1641 bp, Homo sapiens
  Payload ID: 15063
  Gene Symbol:
  Gene Name: RP11-49K24.9
  ENST ID: ENST00000611323
  CDS Start-End: 1-1641
atggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctgcgcgccagcgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagctgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 178299 - DNA, 1449 bp, Homo sapiens
  Payload ID: 15064
  Gene Symbol:
  Gene Name: RP11-49P4.7
  ENST ID: ENST00000634804
  CDS Start-End: 88-621
gaccagcgtgaggaggctcctggcagttgggctgttccgggccggcggcaggagggagcttgatgcgtgcctggcgtgcgcaggccgatgccgccggcagaaaagagcgaggggccaccggtcccggcgcccgcggaacgcgcccggggccgggtgcccggcctgccgtcgccggcgctgtgctgcgcctgcggtctgtgcgcgctgctggcgggcgtgaacgtgacgctggcaggcgccttcgcctccttcttgcccgagcacaacgcgctgctcgtcgtggggctggcgctgctggtgctggcgctcggcttcttcgcggcctgctgcgtgtgtagccgccggggcctcgcgccccgtgggcgctcggcggccgcggcgggcccgggccagggtggcggccgcgccgggcccgtggcgctggagatggagagcagcgagcccacggcacaggacaccacggccgtgcagctcagccctgccgtctccgccgcgtcctccggctgctccagccccggccccagccccctcgccctggaggccccggcgcccgcggccgtctgcgcgctgcgctcggaaggagtccagctcaacccaccccgggcgcgcgccgccccctagcggaccagggccccgccgtgactccgctgtccgggttcattccccttccttcagtgccatttaaggggggaaaagaaagaaaagaaaaagaaaaaagaaaaccttttcttccttccttcctttcttttttacaagggtctggtgctgggctcaggtggcctcatcttttccatctcccaaactcctgggtagaatgtggtgatggtgtcaggggtcacaccccaaagaagggagcagcagagccttggccccttagacagggtctctggtctctagtaaaccttacccatccagcttgctgaaagtaggcccctggaccctggaaccctgacactgccacctccccctggcatttgggcactgtgaaccaaggagcacccaccctgaaggggctaaccaccagcagtccccccagtgaggtgggaggaagagagggagaagggttgaatgtcagcctgggctgtctctgtccttgcacacaccgtgaaaggcttccagtcccctctcctgcccctccccaccttccttgtttctaccccaacatgacctttgggattcatttggctgagaagccgtggctctgacttgggccaggatggtccctagaattagggccggggtgagcactccccaccctttctgtctgactaagagcaagagtagctgagactggggccctgacagaggtgagtggtgagggagcttctgcagccctgaaagtcctagtgtgactttcactgccagcaatgctggcccccacccaccctgactgtggcacaccatgcattcctgcagtgccttactcctcaataaagcacctttggagtc

SEQ ID NO: 178300 - DNA, 818 bp, Homo sapiens
  Payload ID: 15065
  Gene Symbol:
  Gene Name: RP11-500M8.7
  ENST ID: ENST00000536588
  CDS Start-End: 1-155
gatccccagaagtgatcctgggccacccctacgacgtggccattgacatgtggagcctgggctgcatcacggcggagttgtacacgggctaccccctgttccccggggagaatgaggtggagcagctggcctgcatcatggagctcaccaactaagacgtttgtgctcacatggaaggagaagtgctccttgatgtccggacaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtacgtat

SEQ ID NO: 178301 - DNA, 583 bp, Homo sapiens
  Payload ID: 15066
  Gene Symbol:
  Gene Name: RP11-505K9.4
  ENST ID: ENST00000566309
  CDS Start-End: 1-297
gttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagatggagtctcgctctgtcgcccaggctgaagtgcagtgactcagtcttagctcactgcaacctccgcttcccgggttcaagcaattctcctccctcagactcctgagtagctgggattacagtatcggcctttgtcttagtcaagctttcgaggagcaactcagcaattctgttaccgataatcacctaacagtttacacattcaaaaccactgggaagccacagaccaggcaccgtgggatggggaagtggagaccgagaggctgctgccggggaaatatgcagtgcagacaagaggttcctgctactctcacctcatcagagt

SEQ ID NO: 178302 - DNA, 458 bp, Homo sapiens
  Payload ID: 15066
  Gene Symbol:
  Gene Name: RP11-505K9.4
  ENST ID: ENST00000563312
  CDS Start-End: 1-276
gttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagtatcggcctttgtcttagtcaagctttcgaggagcaactcagcaattctgttaccgataatcacctaacagtttacacattcaaaaccactgggaagccacagaccaggcaccgtgggatggggaagtggagaccgagaggctgctgccggggaaatatgcagtgcagacaagaggttcctgctactctcacctcatcag

SEQ ID NO: 178303 - DNA, 723 bp, Homo sapiens
  Payload ID: 15066
  Gene Symbol:
  Gene Name: RP11-505K9.4
  ENST ID: ENST00000561562
  CDS Start-End: 1-526
ggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagtttacacattcaaaaccactgggaagccacagaccaggcaccgtgggatggggaagtggagaccgagaggctgctgccggggaaatatgcagtgcagacaagaggttcctgctactctcacctcatcagagttgttttctaccaggaaccagccccagccccagccccagcccctgctggcagatgctccggtaccctgggctgtggcttccaggatgtgcctgactccagggcagggctgtggccaccagggccaggacgagggtgaggagggggaggcatcacctcaggcacaaaattttaggggcagcaaagcactcccatcaccagaatacatactgtgtccatgcagtgttcttacacatcaaaattcatgaaaaaaaatccagaatggaaaaaatatcaaacttttattataaaca

SEQ ID NO: 178304 - DNA, 1052 bp, Homo sapiens
  Payload ID: 15067
  Gene Symbol:
  Gene Name: RP11-506B6.7
  ENST ID: ENST00000585611
  CDS Start-End: 843-1052
tcccctttggagatcactggaaacagcttctggaccacaaatggggtgaactactgtatcgagaaaggagagagtaagacttgagagctatctttttagctcagggtgcagtctgtactctaaaacaagtgtggaagtggagcactctacatatcctaagtgccaaaaatattcctcttcatgaaattcgccagatctgcaaaacacagctccttttgaagagaagagccagggaactccattagcaggctttgatggcattaataattcagagagatgccctctatcttctttaagatagacagaagggtcccttttaatgtataaccaggcagaaaagaggagaggacacgggtgggagagaagaggaggttgcaagccagcacctgccccacaccaggggatggaagctaattgtgaaaagctgccccactacagctgctgcctcttgaaaaatgcaaactgtgttttgagcaaacatatcatccacttgcagtataaaaacgctggtgtctctccgcggaaactccgagaggagcagaggtctgtagaggtagagacgtaggcttcggatcttttagaattctgctggaagtctccaagtcaagaggatctacaaagaaatactgagtggagactatactgagattctgttaaagacccacttgaattcagcccccattaggagaaactttggccggagcagccaacacatcacctggaagtcttcagactagactattgaagagtggattgtgtactgagggctcccaagtgcttccagaagccaataaaggatcacttcagtttacttcacggctaaggagtaacccttaagaaccatggccaaacgcctgcaagcagagttgtcctgtccagtttgcctggattttttctcctgttccatttctctctcttgtacacacgtgttctgctttgattgcatccagaggtatatactagaaaaccatgattttagagcgatgtgccccttgtgtcgagacgtggtgaaggtacctgctttggaagaatggcaagtgagcgtcctaaca

SEQ ID NO: 178305 - DNA, 567 bp, Homo sapiens
  Payload ID: 15067
  Gene Symbol:
  Gene Name: RP11-506B6.7
  ENST ID: ENST00000590673
  CDS Start-End: 462-567
tcccctttggagatcactggaaacagcttctggaccacaaatggggtgaactactgtatcgagaaaggagagagtaagacttgagagctatctttttagctcagggtgcaggcagtataaaaacgctggtgtctctccgcggaaactccgagaggagcagaggtctgtagaggtagagacgtaggcttcggatcttttagaattctgctggaagtctccaagtcaagaggatctacaaagaaatactgagtggagactatactgagattctgttaaagacccacttgaattcagcccccattaggagaaactttggccggagcagccaacacatcacctggaagtcttcagactagactattgaagagtggattgtgtactgagggctcccaagtgcttccagaagccaataaaggatcacttcagtttacttcacggctaaggagtaacccttaagaaccatggccaaacgcctgcaagcagagttgtcctgtccagtttgcctggattttttctcctgttccatttctctctcttgtacacacgtgttctgctttgattgcatcc

SEQ ID NO: 178306 - DNA, 894 bp, Homo sapiens
  Payload ID: 15067
  Gene Symbol:
  Gene Name: RP11-506B6.7
  ENST ID: ENST00000587816
  CDS Start-End: 509-894
tcccctttggagatcactggaaacagcttctggaccacaaatggggtgaactactgtatcgagaaaggagagagtaagacttgagagctatctttttagctcagggtgcaggttcaagcaattctatgcctcagcctcacaagtagctggaattacaggcagtataaaaacgctggtgtctctccgcggaaactccgagaggagcagaggtctgtagaggtagagacgtaggcttcggatcttttagaattctgctggaagtctccaagtcaagaggatctacaaagaaatactgagtggagactatactgagattctgttaaagacccacttgaattcagcccccattaggagaaactttggccggagcagccaacacatcacctggaagtcttcagactagactattgaagagtggattgtgtactgagggctcccaagtgcttccagaagccaataaaggatcacttcagtttacttcacggctaaggagtaacccttaagaaccatggccaaacgcctgcaagcagagttgtcctgtccagtttgcctggattttttctcctgttccatttctctctcttgtacacacgtgttctgctttgattgcatccagaggtatatactagaaaaccatgattttagagcgatgtgccccttgtgtcgagacgtggtgaaggtacctgctttggaagaatggcaagtgagcgtcctaacacttatgaccaagcagcacaatagccgacttgagcaaagtctgcacgtgagggaggagctccggcattttcgggaggatgtgaccctggatgcagccactgccagctccctccttgtcttctccaatgatctaagaagcgctcagtgtaagaagatccaccacgatctgacaaaaga

SEQ ID NO: 178307 - DNA, 2281 bp, Homo sapiens
  Payload ID: 15068
  Gene Symbol:
  Gene Name: RP11-507M3.1
  ENST ID: ENST00000610442
  CDS Start-End: 90-728
aaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcttgttctgtctcccagctggagtggatacaagcatggcttgcttcagcctcaacctcccggactcaagtgatcctcccacctcagcttcctgagtagctgggactacaggtgcctgccaccatgcccagctaatttttaaacgttttgtagagacgcggtcccattgtgttgcccaggctggtcttgaacacctggcctcaagcgatcctcctacctcggcctcccaaagtgctgggattacatgcatgagccaccatgactggcctagactttttgatttaaagagactttttggatagaaatgcttttctctattacagttataaatgactaaaaatactagctatgccaaaatggcaaccagaggccgactgcaaagcttcaaaaggcttgatgctctcctggtagacaagtcttcagtctcttaaatgtttttttcatatgttgacattgaaatttcattttgtgtagatgttgggattatgtctcattcatttatttattcatcattcacttagtaagtatttaagtgcctgtttttcccaggtgctctgccaggttctggggatataaggatgagccaacataggctctctgccctaaagttagtgggagaaacagtaacaaaagattttaatactatgagattaactgacttagttgtggtatgtagaaagagacacagagcctgcagcaagagcctaggtgaagactcagtgaagcactacctattgaaaggagaatctttcaaatccttaacagttattttcaccatgtaaaaaaggcgacattgccagggaacatcaagtaaagagacaaatgctcagtcagagttttcgcattttcctgattggcccaaatgttttgaagtcggtttcttcacatcagaatccaaaccaggtccacctgtggcaccttcacccttcagtgggagtaaggagccggacgcgtcacttaaaaccattcctcttacgttgtcaccctcaatcttacagggattctcctgtccatggctgccaccaaaactgcgagttatgatgaacatttcaggccagaaaagttaagagaatggccggagcccgagtccgtttctttaatggaggattgtgacagtgcctgctttaaagcaggcgttgaaggggaatgttcgggctcagatttggccgagagtgtggccaagagtgtttccagtcgccagcctgggggctggcgcaccgacgggggcgggcagccgggcgggtgaaggcagccaccccagctccccggcagaagccaggtctgggcttgccagtcaattctgcatacttcagcgtctggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagac

SEQ ID NO: 178308 - DNA, 859 bp, Homo sapiens
  Payload ID: 15069
  Gene Symbol:
  Gene Name: RP11-511P7.5
  ENST ID: ENST00000491664
  CDS Start-End: 197-808
agctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtcc

SEQ ID NO: 178309 - DNA, 521 bp, Homo sapiens
  Payload ID: 15069
  Gene Symbol:
  Gene Name: RP11-511P7.5
  ENST ID: ENST00000481877
  CDS Start-End: 66-350
gtcctttccgggagtgggagcgccgggacttaattacggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaag

SEQ ID NO: 178310 - DNA, 1167 bp, Homo sapiens
  Payload ID: 15069
  Gene Symbol:
  Gene Name: RP11-511P7.5
  ENST ID: ENST00000498682
  CDS Start-End: 201-812
cgcatggtcgccgctccggcccgggcgggcgcagcgctggcagccccgttttccgccagccgggctgccggagagttagacctcccagcctcacggggctgctgtgcggctgcgacgacgccggcgactgcggcgctgcagcggagacggaaggctcgggaggcggcgccatggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctg

SEQ ID NO: 178311 - DNA, 2748 bp, Homo sapiens
  Payload ID: 15070
  Gene Symbol:
  Gene Name: RP11-512M8.5
  ENST ID: ENST00000535844
  CDS Start-End: 16-1632
gggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaacaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacagga

SEQ ID NO: 178312 - DNA, 600 bp, Homo sapiens
  Payload ID: 15071
  Gene Symbol:
  Gene Name: RP11-514O12.4
  ENST ID: ENST00000507747
  CDS Start-End: 1-557
gcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaaaccacagaggaggatctcaacctggatgtggagcccaccacagaagacactgcagaagaagtaactatacacgttttattacactctgctttgtttggggagattgggcccagaaggtggtgaagggggaaatggaagtttgaaattaaatatctgtgagcagtta

SEQ ID NO: 178313 - DNA, 3569 bp, Homo sapiens
  Payload ID: 15072
  Gene Symbol:
  Gene Name: RP11-514P8.6
  ENST ID: ENST00000519541
  CDS Start-End: 129-1019
tgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgccccagctcttctccttcaagcccagctcaggtgccgcctcttccaggaagccccctgggaccatctccagtctcagtgggagcagtgtgtccttggttgctcccagagtctatagcagagatctggacccaagactctggactcccggctttgggctggcagcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctct

SEQ ID NO: 178314 - DNA, 911 bp, Homo sapiens
  Payload ID: 15073
  Gene Symbol:
  Gene Name: RP11-514P8.7
  ENST ID: ENST00000514917
  CDS Start-End: 83-911
gcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 178315 - DNA, 2128 bp, Homo sapiens
  Payload ID: 15074
  Gene Symbol:
  Gene Name: RP11-51F16.8
  ENST ID: ENST00000580553
  CDS Start-End: 1-164
aagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagaga

SEQ ID NO: 178316 - DNA, 397 bp, Homo sapiens
  Payload ID: 15075
  Gene Symbol:
  Gene Name: RP11-51L5.7
  ENST ID: ENST00000602932
  CDS Start-End: 32-241
agattgctcctcttcaccatctacaaatggaatgttcatccttactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatggatggacgtggtagaggtcgcgggtagttggtgggcacaagagcgagaggacatcattatgaaatacgaaaagggacaccgagctgggctgccagaggacaaggggcctaagccttttggaagctacaacaacaacatcgatcactttgggatgcagcatgagacggagctgcctcctctgac

SEQ ID NO: 178317 - DNA, 988 bp, Homo sapiens
  Payload ID: 15076
  Gene Symbol:
  Gene Name: RP11-520P18.5
  ENST ID: ENST00000562505
  CDS Start-End: 222-638
cgtgattggggttgaccccctcctccccggcctcgggctattttccgcaggaggccgctgcaggcagacgctgaggccctcggggaccccggagccgccccagtacaagagccccgaggaggggctggccggtcccgccccctcggtcccagggctgactcctcctccaggacgcagatccctgcagcccggcaggagagaaggctgagccttctggcgtcatggagaggctcgtcctaaccctgtgcaccctcccgctggctgtggcgtctgctggctgcgccacgacgccagctcgcaacctgagctgctaccagtgcttcaaggtcagcagctggacggagtgcccgcccacctggtgcagcccgctggaccaagtctgcatctccaacgaggtggtcgtctcttttaaatggagtgtacgcgtcctgctcagcaaacgctgtgctcccagatgtcccaacgacaacatgaagttcgaatggtcgccggcccccatggtgcaaggcgtgatcaccaggcgctgctgttcctgggctctctgcaacagggcactgaccccacaggaggggcgctgggccctgcgaggggggctcctgctccaggtgggcctcagcctcctcagggccctgttgtgagggccctccctttacgccccctcctggccctgctggcccatcccgtctcctgcctccaactgccatcctgcctccgccccttccaggacactggggggggaccctccctctctgaggtggtggggagggtgccattgcctccatcccggatctagccacctcactcctccccaccgggggcccctttgctggagaaccccaaggattcagcaactgctcctcctggggaaggacagtgcctctgatgtgggtgatgggaaggacggtgcctctgatgtgggtgatgggaaggacggtgcctctggtgtgggtgatgggaaggacggtgcctctggtgtgggtgatgggat

SEQ ID NO: 178318 - DNA, 987 bp, Homo sapiens
  Payload ID: 15076
  Gene Symbol:
  Gene Name: RP11-520P18.5
  ENST ID: ENST00000631950
  CDS Start-End: 222-638
cgtgattggggttgaccccctcctccccggcctcgggctattttccgcaggaggccgctgcaggcagacgctgaggccctcggggaccccggagccgccccagtacaagagccccgaggaggggctggccggtcccgccccctcggtcccagggctgactcctcctccaggacgcagatccctgcagcccggcaggagagaaggctgagccttctggcgtcatggagaggctcgtcctaaccctgtgcaccctcccgctggctgtggcgtctgctggctgcgccacgacgccagctcgcaacctgagctgctaccagtgcttcaaggtcagcagctggacggagtgcccgcccacctggtgcagcccgctggaccaagtctgcatctccaacgaggtggtcgtctcttttaaatggagtgtacgcgtcctgctcagcaaacgctgtgctcccagatgtcccaacgacaacatgaagttcgaatggtcgccggcccccatggtgcaaggcgtgatcaccaggcgctgctgttcctgggctctctgcaacagggcactgaccccacaggaggggcgctgggccctgcgaggggggctcctgctccaggtgggcctcagcctcctcagggccctgttgtgagggccctccctttacgccccctcctggccctgctggcccatcccgtctcctgcctccaactgccatcctgcctccgccccttccaggacactggggggggaccctccctctctgaggtggtggggagggtgccattgcctccatcccggatctagccacctcactcctccccaccgggggcccctttgctggagaaccccaaggattcagcaactgctcctcctggggaaggacagtgcctctgatgtgggtgatgggaaggacggtgcctctgatgtgggtgatgggaaggacggtgcctctggtgtgggtgatgggaaggacggtgcctctggtgtgggtgatggga

SEQ ID NO: 178319 - DNA, 2110 bp, Homo sapiens
  Payload ID: 15077
  Gene Symbol:
  Gene Name: RP11-529K1.3
  ENST ID: ENST00000443119
  CDS Start-End: 75-1514
acccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatcc

SEQ ID NO: 178320 - DNA, 867 bp, Homo sapiens
  Payload ID: 15077
  Gene Symbol:
  Gene Name: RP11-529K1.3
  ENST ID: ENST00000567706
  CDS Start-End: 85-867
cctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccag

SEQ ID NO: 178321 - DNA, 565 bp, Homo sapiens
  Payload ID: 15077
  Gene Symbol:
  Gene Name: RP11-529K1.3
  ENST ID: ENST00000565116
  CDS Start-End: 105-197
gtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctggg

SEQ ID NO: 178322 - DNA, 1042 bp, Homo sapiens
  Payload ID: 15078
  Gene Symbol:
  Gene Name: RP11-540D14.8
  ENST ID: ENST00000505139
  CDS Start-End: 77-778
actttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaa

SEQ ID NO: 178323 - DNA, 2349 bp, Homo sapiens
  Payload ID: 15079
  Gene Symbol:
  Gene Name: RP11-542C16.2
  ENST ID: ENST00000315601
  CDS Start-End: 1-995
gtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 178324 - DNA, 2571 bp, Homo sapiens
  Payload ID: 15079
  Gene Symbol:
  Gene Name: RP11-542C16.2
  ENST ID: ENST00000575474
  CDS Start-End: 1-1217
cttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 178325 - DNA, 2096 bp, Homo sapiens
  Payload ID: 15080
  Gene Symbol:
  Gene Name: RP11-544M22.13
  ENST ID: ENST00000289779
  CDS Start-End: 56-241
gccgagagggcgggccagggccgcactccggagactcgcggttgctacgcgcaccatggctggagacggagtttcgctcttgatgcccagcaggctggagtgcaatggcgcgatttcagctcactgcaacctcctcctcccagaggtacttctcagccctctagctccaactgagaacccagccagtcaggaagtcgctacttcgggaacaccaaccaatcagggggccgtcacctgctgaaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaa

SEQ ID NO: 178326 - DNA, 813 bp, Homo sapiens
  Payload ID: 15080
  Gene Symbol:
  Gene Name: RP11-544M22.13
  ENST ID: ENST00000470694
  CDS Start-End: 74-181
acgggagatgttgcaggcgccgagagggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctg

SEQ ID NO: 178327 - DNA, 2268 bp, Homo sapiens
  Payload ID: 15081
  Gene Symbol:
  Gene Name: RP11-545J16.1
  ENST ID: ENST00000381541
  CDS Start-End: 66-2129
gtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattacaggtattctaaagaaaccaatattgatccatcagaaaattcaacatcaaacttaccaaactgtttaattaatcaaatgttatcactcaatagaacaccgtctgagataatagaaagaggttgtgtgaaggaatctgggtcacacatgtggatctatgtcttcatgggtaatatgcttcgtggcataggggaaacccccatagtaccattggggatttcttacattgatgattttgcaaaagaaggacattcttccttgtatttaggtactgtgaatgtaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaactttttgttgggagtcctcgccctacctgctgttgcaattggcatgttttcaggaggatatatcattaaaaaattcaaattgtctttagttggacttgccaaattggcattttgttctgcaacagtgcatctcttatctcaagttttatatttctttctaatctgtgaaagcaaatcagttgccggcctaaccttgacctatgatggaaatagtccagtaagatctcatgtagatgtaccactttcttattgcaactcagagtgcaattgtgatgaaagtcaatgggaacccgtctgtggaaacaatggaataacttacctgtcaccttgtctagcaggatgcaaatcttcaagtggtaataaagagcccatagtgttttataactgtagctgtgtggaagtaattggtctccagaacaaaaattactcagcgcacttgggtgaatgcccaagagatgatgcttgtacaaggaaatcttacgtttattttgtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaaagcatgtaattaagaggaggaaaaaaataattttgctgctgtttccaactaatgtattgattccataagacgttatttttgtggtgttctgagtcttttcactgagaattcccacattcttcacttatgatgcaacaat

SEQ ID NO: 178328 - DNA, 2451 bp, Homo sapiens
  Payload ID: 15081
  Gene Symbol:
  Gene Name: RP11-545J16.1
  ENST ID: ENST00000540229
  CDS Start-End: 66-2312
gtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaaagcatgtaattaagaggaggaaaaaaataattttgctgctgtttccaactaatgtattgattccataagacgttatttttgtggtgttctgagtcttttcactgagaattcccacattcttcacttatgatgcaacaat

SEQ ID NO: 178329 - DNA, 2775 bp, Homo sapiens
  Payload ID: 15082
  Gene Symbol:
  Gene Name: RP11-546B8.6
  ENST ID: ENST00000619056
  CDS Start-End: 126-401
aatccgcagaagccccttggacgctaccgccgccggaggaacgaaaggggcgcactacccggggcaggcttcgcgctgcctgcgcgcggggcgaggggagcaccgtagcgttctccgcgccccggatgacgccgacccgcgtggggagaattcgcccccgcccgggtttcggccgcggcctcgcggccactttggagacactccctggctccggccaggcggaccgaggcgtgactcgcaggtgcccacgcgtgccagctgcggctgggctagggacgcggggtcgcccggtggggagcggggacctgactctcgtaattcgttgcaggatggaagggggctgtggtcgcgcgtgggaacccgctcgcggctcggcgggtctagggacttcgggttcctgaatgtcaaaggcgcgggcagctcctagagcaaattgcgggatttctttgggaaacgcgactggtgagcccttcccggctccagtccactttgggcgctggaaccactccccgttctgctcgcgcctcagtgactgtctacccggcccagggcaccgtggacaggaccgcacacgaagtagtcaccttccgctgcagctttggggagacaagcggaatcattttcttccagcgaattctaaaatcgttaggtgcaaactctttgagtgtcgcacccctggcctgggttcttcctcccgctccttgtggtgtggacagtggtgagagctcggatgtgctgttgttggccagaagtgtgttcaaatttggactggccatttcctcgctgagtgaccttgagaaattgactctatatatttagatttcggttttctcgtttgcaaaaaaggaaaataatgcatgcatgcgggttgttcgtgagccgcgagtgagatattgagggagcgcagagcactgggcctggcacgtagtaggcactgggcagcgtggctcacctcccactctatccccccagagtaatggctgatgtattattgttgtgactcttgtttattttgttggcagtttaattttatttgcaggggctcagtacgttggagagaaaggtgtatttgtctaccagtagggtcagtttcagaggacggggaaagacaggaggtgcaggttggggattctttctctcttctcccaacaatccaaaggcgtcaggatttgcagggcctccaggcctgggtctggagttaggtcacttgcccgctgtgtgaccttgggcaaattcctggcccttgctaagccttcctggtgggtgtggagagggaggcccaacagtgaggagtgagagctgcaggatgtctggggtctgggcaagtgctccctcactcccttccagcgacaacgaccctcagatggggtagatgccattgccctggctccagggggcctcctgcttctaattcaggctctgccactggcagtgtgggtccctaaccgcccctcccagaaccgcattttccttatttgtaaaacaaaaagggcaccagctacccccagggtggctgtgagaacaaaatgagataacatctgtggcagtgcctgtgtgaaactctggcggttatatcataataactttaatgacaactataaagctactgtagctgagaccctagcctgtgccaggcagggaggtggacacttatttattcttcacaatgaccctgtgaggaaagggctgttagtggccccaatttctcactaatgagggaattgaggctttgagagttcaagggaagcacagctccccacttgggggctggagttggcacctcaccagctccacttcccttctggcttccagtgcccgggactcagggctgcccttgtcacttcagacactgttaaatcaggacaacaaggcccaccgcacagaggtttgtggcacagaattaaggcgtgggtggcacagcgctgctcccagcttgtgtgcttaagaatgggattcccacctcagtttaccagctgtggactcagggaattattcatcctctttatgcctcagttttctcatctggtaaataaacctcatgggattaaataagcgccccaggtaaagcctggcacgggtcagggctctgcttcactgcttggcttccggcttcctgagatccacggtccctcatcgtccagccctgtcatacagatgaaggagctttgggccactaattataagcctcctttcacttcctatccagatagctcttaggcagctcaggaatggggggaacttggttagtccctaggacagtggttctcagagtgtgtttccagagcagcagcatcagcatcactggagaatttgttagaaatgcaaattattggaccctcgccagacctacggcatcagacactctggggtaggactcggcagtctgtgcttaacaagccctccaggtgattctgatgcctgctcaactctggaagccagtgcccagaatatggtccattccatctgagttttcaaatgtgttgttgtaacattgtgggaagattctctcagaatttgcaactctcatacgaatctgtactaatgccttccacttctcattccccgtgtcgctcattcatgccttctcctgatcatacttgccaaaggtttgttattttgttggtttttaaaaaagcctttgatgtcattatccccttttaagatgccacctctttcgtgaatgttgcggtttaaaaaaagatttattccttctttgctgagttgaaaatttaatttgtcaattttctttctttttaaataaatgcactcaagggc

SEQ ID NO: 178330 - DNA, 1848 bp, Homo sapiens
  Payload ID: 15083
  Gene Symbol:
  Gene Name: RP11-548K23.11
  ENST ID: ENST00000370649
  CDS Start-End: 331-1680
gtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggagctgtggggggcgtctgcgccctggccaatgtcctgggggctcaggtgtgccagctggagcgactgtgctgcacggggcaatgggaagatgcccagaaactgcagcaccgcctcattgagccaaacgctgcgaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatc

SEQ ID NO: 178331 - DNA, 1886 bp, Homo sapiens
  Payload ID: 15084
  Gene Symbol:
  Gene Name: RP11-552F3.12
  ENST ID: ENST00000590947
  CDS Start-End: 1-228
aaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgacagtgagtagctgcgcctggatttgagttctgctctggccaatccccaagctccacgctgtcagccaccccgctctcctacctcccagaggagcaggctacactcctgttccttttagagagagaaatattgcggccgggcgcggtggctcacgtctgtaatcccagcattttggcaggccaagggttttgccatgttcgtagggctggtctcaaactaattacctcagatgatccgcccacctcggcctcccaaagtgctgggattacagccgtcctgggccgccggacacccccgctggggccgatgcccaacagtgacatcgacttgagcaacctggagcggctggagaagtaccggagcttcgaccgctaccggcgccgagcagagcaggaggcgcaggccccgcactggtggcggacctaccgagagtatttcggggagaagacagagttccagctcctaaaatatttgctcctaaaatcttgaccacctgactttccggattgggatgccgttctgtgcgcctcaaatactctgtagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgg

SEQ ID NO: 178332 - DNA, 550 bp, Homo sapiens
  Payload ID: 15084
  Gene Symbol:
  Gene Name: RP11-552F3.12
  ENST ID: ENST00000587556
  CDS Start-End: 1-372
cagggccctgcagcctccagccagagtgccctcatgcctcctgctcccaccacccgttggtgcagccagccgccaactggcctggaccccagccccttgcacctccatgccaggctggcactgctgaggcacatggcagagcagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgacagtgagtagctgcgcctggatttgagttctgctctggccaatccccaagctccacgctgtcagccaccccgctctcctacctcccagaggagcaggctacactcctgccgtcctgggccgccggacacccccgctggggccgatgcccaacagtgacatcgac

SEQ ID NO: 178333 - DNA, 3857 bp, Homo sapiens
  Payload ID: 15085
  Gene Symbol:
  Gene Name: RP11-561B11.2
  ENST ID: ENST00000557565
  CDS Start-End: 382-2133
tgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaacttactctgtcgccagggctggagtgcagtgacgtgatcacagttcactgcagcctcaaactcccaggctcaagcaatcttcctacctcagccctcctgagtaattgggactacagaacagagaatgtcagtatccaataggatgccagtggaattccctgacgattccatccatgcggctctgctggagcagggtagtgtcctaggctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 178334 - DNA, 830 bp, Homo sapiens
  Payload ID: 15086
  Gene Symbol:
  Gene Name: RP11-565P22.6
  ENST ID: ENST00000367932
  CDS Start-End: 1-156
aagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtcccagcagacgcttcacagccagaggccaccatggaaagagaagagagaggcaaagttctgcccaatggagaggtttccctgtcagtacctgacctaatccacaaggatagccaggacgaatccaagctaaagatgactgagtgcagaagggcctcct

SEQ ID NO: 178335 - DNA, 541 bp, Homo sapiens
  Payload ID: 15086
  Gene Symbol:
  Gene Name: RP11-565P22.6
  ENST ID: ENST00000431696
  CDS Start-End: 91-541
cacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccct

SEQ ID NO: 178336 - DNA, 2776 bp, Homo sapiens
  Payload ID: 15087
  Gene Symbol:
  Gene Name: RP11-566K11.2
  ENST ID: ENST00000556922
  CDS Start-End: 95-2488
ggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctgctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagata

SEQ ID NO: 178337 - DNA, 679 bp, Homo sapiens
  Payload ID: 15088
  Gene Symbol:
  Gene Name: RP11-571M6.15
  ENST ID: ENST00000471530
  CDS Start-End: 1-484
gtgcaattatttcgagagtcaaaatgtggatttccgaggcaagaaggtgatcgaactgggtgcggggacaggcatcgtggggatcttggcagcgctgcagggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacagacggagtcttgctctgtggcccaggccggcgtgcaatgagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggcagagatctggctccacaaggaggcccagaaggagggctggagcaaagctgccaagctccaagggaggaagaccaaagaaggcctgattgggctgttgcaggaaggaaacacaactgtattagtagaggtaaact

SEQ ID NO: 178338 - DNA, 373 bp, Homo sapiens
  Payload ID: 15088
  Gene Symbol:
  Gene Name: RP11-571M6.15
  ENST ID: ENST00000546504
  CDS Start-End: 1-373
gtggatttccgaggcaagaaggtgatcgaactgggtgcggggacaggcatcgtggggatcttggcagcgctgcagggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacagacggagtcttgctctgtggcccaggccggcgtgcaatggcagagatctggctccacaaggaggcccagaaggagggctggagcaaagctgccaagctccaagggaggaagaccaaagaaggcc

SEQ ID NO: 178339 - DNA, 914 bp, Homo sapiens
  Payload ID: 15089
  Gene Symbol:
  Gene Name: RP11-574F21.3
  ENST ID: ENST00000485079
  CDS Start-End: 1-914
gaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgctgacgtggctttttttctgtggctcccagtgggtctacggaccttggctgacatatgttgagacgggtttcaccatgttggcctggtttcaaacgagtttcgaactcctgacctcaagtgatccgcccacatccgcctcccaaagtgctaggattacaggcatgagccaccgcgcccggccagaccttacatttttaaaaagcactctggctgccttatgtttaactgtaatggcaataatggaagtagacaaacgaggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaa

SEQ ID NO: 178340 - DNA, 2635 bp, Homo sapiens
  Payload ID: 15089
  Gene Symbol:
  Gene Name: RP11-574F21.3
  ENST ID: ENST00000556710
  CDS Start-End: 252-2507
agcaagatggccgccgctgaggaaggctgtagtgtcggggccgaagcggacagggaattggaggagcttctggaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtggaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgctgacgtggctttttttctgtggctcccagtgggtctacggaccttggctgacatatgttggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagac

SEQ ID NO: 178341 - DNA, 5818 bp, Homo sapiens
  Payload ID: 15090
  Gene Symbol:
  Gene Name: RP11-574K11.31
  ENST ID: ENST00000603027
  CDS Start-End: 625-3072
gcggcggcgcgccgcctcccccggtgggagcggtggttgggccaggctgcggcagagcgttcgctcggagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgccttcattttctcctgtcagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttttgtctgcctccctggagtgggaaaaacctagactaaagcaagtgtcagaagtttcctccccagttgaaggttcatctgcacatggaatttggaaagaagggaaaggcccaggtcgactagagtaaaaaaggagtttatatatttataaatgccaaataaataccagaggccacccaacgccccctcccagacagggctgtctcccccagccctaggcttctagggtgtgagacatcttggccccaagctatagcccaagagcagctgtcagtctgtgctaccagggaactgagtgaggatgatctgtccagccaagtttcactccccctgtgtgaggggcccccatagccacaggcctgggtccctgtataggaccctaagggtgaaagactcagggggagaaggtggccatctcgagtgagacccgctgccacagctccttggtctgtttgctgcgcttgaggttctgtaggatgtcgttgaactgcatcatgcccatgggcgtcaggcagaaggcgctgcgggcactccggatcgcattcacaaagtcgtcgtagtccgcaggagtcagtaaacaaatgaagagctagaggaagggtcctctgaagagccactggcacaactgcaggaaacgtgggaagaataagtacgtgagagccagttgggagaaacaaagttgtgcaggccaagggcataaagcccaatctcgaaggcgcaaaggtgcaggttgcggtgaggaccctggtggccccctgaggaagatggatgtgtgaaaatggaagtgctgctgttgccccctgccttgatcagcactgtcttcgccagctcgaagtagaagtgtgcagctgcctctgatggctgattggtcttcgcccgggctcctccactggcactggcccggcgacttccactggaggatgaggagcccagggagtccgaagaagagctgctaatgctgtcactgtcctgacctcgaccccaggaggtgggggcccagccccctcgaagtggtctccggcttaaggtgggggaactatccgatgttgtttcaggggcactgctgtcaatgctggccatgcctaacccccaagagaagtcagtctcagaagtcaggagtcccagatgttaagactccaaccttcaggattatccttccctctatgctagcccacaggctatcctacctgtgtgcttcttcttaggccgtcctggggacccccatccccgtccattatagcctccacgactgccaagtgccaagcggctaggaaccttcccttctggccttggggtcaaagctgcctcagatggaagaccctcacagggggaatgtggggaactctctaggtgaggaaaacaggacgctgggatgagcccaggaaaggggacctcaacataggtccacaccattcatcccccctgcccagtgcccccacctcaccaggcacattcttctctgtgaagccctcagtggggcctggcccagcccctgccacactccctggttgagcaggccctgcagagcctgaggtcagtggttgcagggcccctggggcagatgggcccccgtgctttgaaggagacctctggctggctgtggttgggcggctagatgagtagaaagaactcagcgtctgtggcttatgtgtctggctctctcggtccaagagtttgtctaagatctggaagacagaagcagtgacctccagagaagcagtgacaggatgccctttagctcctgacttctattaccttcctttctccttgaaacagccaattgctacatcctcagggagccttccccacttacaaccacaggatgacctcctggtttacatgtctttttgtaacttatttaaccccaacatatcttggtatcctccattaacaccacagggcagaatatactgatagtcaataaatactgaaataagtgaatgaa

SEQ ID NO: 178342 - DNA, 871 bp, Homo sapiens
  Payload ID: 15090
  Gene Symbol:
  Gene Name: RP11-574K11.31
  ENST ID: ENST00000603706
  CDS Start-End: 1-131
tgattgtggatgggcaagagctgcgtaccaacccagcagcctcaatggagagcatccagaagttcctgggtttgatgatgataagggattttggtgccagggacttgaaggtggtaagactcgctgtctaggccggagcaaaggccggaggtatccagatatggacactgaggaaacgtgggaagaataagtacgtgagagccagttgggagaaacaaagttgtgcaggccaagggcataaagcccaatctcgaaggcgcaaaggtgcaggttgcggtgaggaccctggtggccccctgaggaagatggatgtgtgaaaatggaagtgctgctgttgccccctgccttgatcagcactgtcttcgccagctcgaagtagaagtgtgcagctgcctctgatggctgattggtcttcgcccgggctcctccactggcactggcccggcgacttccactggaggatgaggagcccagggagtccgaagaagagctgctaatgctgtcactgtcctgacctcgaccccaggaggtgggggcccagccccctcgaagtggtctccggcttaaggtgggggaactatccgatgttgtttcaggggcactgctgtcaatgctggccatgcctaacccccaagagaagtcagtctcagaagtcaggagtcccagatgttaagactccaaccttcaggattatccttccctctatgctagcccacaggctatcctacctgtgtgcttcttcttaggccgtcctggggacccccatccccgtccattatagcctccacgactgccaagtgccaagcggctaggaaccttcccttctggccttggggtcaaagctgcctcagatggaagaccctcacagggg

SEQ ID NO: 178343 - DNA, 323 bp, Homo sapiens
  Payload ID: 15091
  Gene Symbol:
  Gene Name: RP11-58C22.1
  ENST ID: ENST00000563764
  CDS Start-End: 1-162
gttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggttaaaacaaagtcacaagtctgacccacactcaaagggagaagattatgcaagagcaaaagcacgagatggaaaccatggggccatcttatagtctgtctgccggagaaagatgaacacaaatcctgaaatttcagcattcctgataccgtgtgtaccagcaaaa

SEQ ID NO: 178344 - DNA, 623 bp, Homo sapiens
  Payload ID: 15092
  Gene Symbol:
  Gene Name: RP11-598P20.5
  ENST ID: ENST00000534420
  CDS Start-End: 1-97
ctggcgaggcagaggcaagcgaccagcagcagaagatcatacccaggccacgtgcagccggccacagcaagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaa

SEQ ID NO: 178345 - DNA, 460 bp, Homo sapiens
  Payload ID: 15093
  Gene Symbol:
  Gene Name: RP11-599B13.6
  ENST ID: ENST00000498285
  CDS Start-End: 97-460
atctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcataggtactggctgtgatcgaacttctcaaccct

SEQ ID NO: 178346 - DNA, 1287 bp, Homo sapiens
  Payload ID: 15094
  Gene Symbol:
  Gene Name: RP11-5A19.5
  ENST ID: ENST00000580114
  CDS Start-End: 1-436
agatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgc

SEQ ID NO: 178347 - DNA, 1473 bp, Homo sapiens
  Payload ID: 15094
  Gene Symbol:
  Gene Name: RP11-5A19.5
  ENST ID: ENST00000518227
  CDS Start-End: 1-113
tggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctac

SEQ ID NO: 178348 - DNA, 501 bp, Homo sapiens
  Payload ID: 15094
  Gene Symbol:
  Gene Name: RP11-5A19.5
  ENST ID: ENST00000518753
  CDS Start-End: 1-137
tgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaaggagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccg

SEQ ID NO: 178349 - DNA, 489 bp, Homo sapiens
  Payload ID: 15095
  Gene Symbol:
  Gene Name: RP11-603J24.9
  ENST ID: ENST00000548861
  CDS Start-End: 10-489
ggttatgtcatgccagatacacacctcaaaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaata

SEQ ID NO: 178350 - DNA, 717 bp, Homo sapiens
  Payload ID: 15096
  Gene Symbol:
  Gene Name: RP11-613M10.8
  ENST ID: ENST00000537239
  CDS Start-End: 1-195
gaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacgctccatttatcttaaagaaattggacagcatatgaagacaggacatcacatatgaatgcacgatatgaagagcctggttacagtttcgactcctctctgcaagtgaataggcccagaaaggtgtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagag

SEQ ID NO: 178351 - DNA, 2591 bp, Homo sapiens
  Payload ID: 15097
  Gene Symbol:
  Gene Name: RP11-613M10.9
  ENST ID: ENST00000540557
  CDS Start-End: 43-936
cggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacaggtttacaggaagcatggagacattcccccagtggctgttttcctgttggcccttgatgacaaaaccttgtcaaagcaattgtgtggagtcaagaagaatgtggctggaatttcagaggcaggaaagtgtccggtcccagcataaaggtatccagttatatgacaccccttacgaacctgaaggccaaagtgttgactcagactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggaaatccagttatcaaaattgactcaagaagagagaacctaacagaacaataacaatggaagaaattgggaacattatcacaaagctatcatcctgccaaactccaggctcagatgtcacagatggttcaagcgattctcctgcctcagcctcctgagtagctgggattacaggcacccgccaccatgcccgactaaatagtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcagatgttaaactctctgaggatgtgggccttgcctgtgctgtgctctgttatgcagtatatccagtgcttggcacataatagatgcacacaaactttcacttgaatgacatagggactgcaaggaaggaacagctgctggaaacgaagacacagaaagacacagaagacacagaaagaatataaacggcagattacctgaccttcatgtcaagtactaagacaagagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 178352 - DNA, 625 bp, Homo sapiens
  Payload ID: 15098
  Gene Symbol:
  Gene Name: RP11-618P17.4
  ENST ID: ENST00000592740
  CDS Start-End: 1-625
caatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaaggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcct

SEQ ID NO: 178353 - DNA, 653 bp, Homo sapiens
  Payload ID: 15098
  Gene Symbol:
  Gene Name: RP11-618P17.4
  ENST ID: ENST00000606020
  CDS Start-End: 257-653
tgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggc

SEQ ID NO: 178354 - DNA, 2188 bp, Homo sapiens
  Payload ID: 15099
  Gene Symbol:
  Gene Name: RP11-619A10.1
  ENST ID: ENST00000614930
  CDS Start-End: 140-406
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaaggttcgtgagccacacatctccccacaccaagctcctccatacaagacctcggactgcatcaggtaaatgctttttcaggggcaaaatctagagaatctgaaacggtgagccttttttcttttctttctttctttttttttttttttttttttttttgagatgaagtctcactctgttgcccaggctggagtgcagtgcagtggtgtgatcttggctcactgcaaactccacctcctggagtcaagtgattctcctgcctcagccttcagagtagctgggatcataggtacccgtccccatgcctggttaatttttgtatttttagtagagacagggtttcaccatgttggccaggctggtctcgaaattctgagctcaagtgatgcacccaccttggcctcccaaagtgctgggattacagcatgagccaccatgcccagctgtgagcctgtatcttaatcaaagtcctgagaataaccttgaagaagactcccttgcaatgaggaacaacagaagaagcaagggacctggaatctggcagacctgggtttgaattctggctctgtcactttctggtgaagtgacttgagtaatgaacatgagcctttctgggtagcatttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctgttcaagttagaaagtaagatacaatgcacacaaagccaaattgtcatcattcagctcctattacaggagaactaagagctgcattgaaaattacttgcaaagcttgtaagtggttctgccacttattagccgtgtgaaccttagcaaattacctagcgtctctgagtttcaacttcctcatctgcaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaagcttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatatgccatagacaagccaatatgtgagtgtactctatctgaataaagtatagcctttctacattgc

SEQ ID NO: 178355 - DNA, 3942 bp, Homo sapiens
  Payload ID: 15099
  Gene Symbol:
  Gene Name: RP11-619A10.1
  ENST ID: ENST00000253803
  CDS Start-End: 111-644
ccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctggcacctccagtgataagcactaattgcctgtatacaacccttttttgtttgaaatatctagagtaatttctgttttcctatctggggtagtgtaacataagaagaaatatatatttggtctctgcccccagttcctaacacaaagctcctaaaacccttggaaattcctgaatgatggcggtgctaagagcattgtcctttgttaatttatcatttttcttttctcctaggtgttttttcctttttaaacttttcttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctatgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactgttttcctgggttccatgagctgttctagcaaatgttcaaacctgaggagggagttgtggggacctccaatttacagccagttggtcagatgcataggtgatgcttggccttgcacctggggtctgacatgcggatggtcctgtgtgactgagcccttaacctgtggagtctggtgctcactctgcttagggcttctcttgcctttttagtgtccttctaggcggcctttccttcctcttgtcagctcagaaaacttttcttccacttcccttcttctaaaccatcccttacatctactcctttccagccgaccaagagcagaaccacggctggttccactgccaccatgctgtcccacactgtctcctcaggatgtattcagatgtccagccctccccccagtctaggagccccccctttgaggaaagggatgctggcctagtcaactctttcccagcaccaggtacagcatctggcacgttccatctttttcatggactctccccaggcggcctgaccttccctcctctgaaccggtgcatttcttgtctgcatcatgtttgccctaatcagatatcaccttatttcctcttttaaaaaatgctttttttctctggcaggcttcatcggaatcacaattttcattcatttagtaactgttgttgtttattctatgtatttttgcaggaggcctgaggtgggctgtgttctcctcctatggcagggcttcactctcctcctcctccgttggggcttcgctgtccctgggataagaataacaatgccaaggttttcattcttgaaaggagcaattaagcttctcaccccctcctcattttagatgggaactgtgagggccccatcatttacccagggtccctgttgaggatcttgtcctcattagatgacttcttgtgcagcttccatgcatgattatttattcttgtggcactgagaggtttgtacatatctttaaaccagagcggctgtccaaatgaggaaagtccatcctagaagatagaaagggaaatattaattttgcatgtcctctgctttccctggccacagcaatgaatcctccaatgtacctgactctcccttcgcgaagagcatcccctccgtggcagaaatctgaaaatgcccctggggagacacatgcacaagacagtgagtgatgcagccgtttcccacgtatctcacaatgtacttctctggtcttattaggactaaatgagtatctcagtccataatcacagggagaaccaccaccacagaccacatacccggggtcttgaaaataattccatgcatgtgggactttcagaagctctccatgtctgcccagaagggccccacaatatactggggggactttgtatgtggctcagcatggagcaggggcaggattttcagtcccactcactcccttggccaagtgcccttgtgcagtgaacaaactgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttatttttgaatttgaataaaataggaaaaggcagagtgcattgtgtgaccatggggtaagtaagacactctccctttctccttctcagttttcctgtcataaaaggacaaactactatctaaggtctccgtagttaaaattcttttttgttgttttttttttatttgagacagtttggctcattccccaggctggagtgcaatggtgctatcttggctccctgcaacctgcgcctcctgggctcaagcagttctcctgcctcagcctcccaagtagctgggattacacgcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccagggg

SEQ ID NO: 178356 - DNA, 491 bp, Homo sapiens
  Payload ID: 15099
  Gene Symbol:
  Gene Name: RP11-619A10.1
  ENST ID: ENST00000619860
  CDS Start-End: 75-338
tcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtagga

SEQ ID NO: 178357 - DNA, 798 bp, Homo sapiens
  Payload ID: 15099
  Gene Symbol:
  Gene Name: RP11-619A10.1
  ENST ID: ENST00000620742
  CDS Start-End: 88-465
aactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatca

SEQ ID NO: 178358 - DNA, 581 bp, Homo sapiens
  Payload ID: 15099
  Gene Symbol:
  Gene Name: RP11-619A10.1
  ENST ID: ENST00000630266
  CDS Start-End: 69-356
aggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacat

SEQ ID NO: 178359 - DNA, 1589 bp, Homo sapiens
  Payload ID: 15100
  Gene Symbol:
  Gene Name: RP11-637O19.3
  ENST ID: ENST00000480294
  CDS Start-End: 133-261
agcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagaagtctcattacagaaaacatctcttctctgagagtaatcaagattcaagtacc

SEQ ID NO: 178360 - DNA, 745 bp, Homo sapiens
  Payload ID: 15101
  Gene Symbol:
  Gene Name: RP11-644F5.10
  ENST ID: ENST00000257899
  CDS Start-End: 1-343
ttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgagggtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaa

SEQ ID NO: 178361 - DNA, 367 bp, Homo sapiens
  Payload ID: 15101
  Gene Symbol:
  Gene Name: RP11-644F5.10
  ENST ID: ENST00000549424
  CDS Start-End: 145-279
tggggcacttgtttcctgagtccgggctggaaatctcggagttaccgattctgcggccgagtagtggagaaagagtgcctgggagtcaggagtcctgggcgctgccgctgacttcctggcgtccctgatgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtgaataatgctggtgtggctggtatcatcggacccacaccatggctgacccgggacgatttccagcgggtgctgaatgtgaacacaatggg

SEQ ID NO: 178362 - DNA, 3382 bp, Homo sapiens
  Payload ID: 15101
  Gene Symbol:
  Gene Name: RP11-644F5.10
  ENST ID: ENST00000550412
  CDS Start-End: 17-385
acagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgaggggtacagggctctgggttccaggactaacagcagcccactcaacaaacgtgggccagcagaggtggttaagatacagcacattggaatagttaagaagagacagtttagggctagacttcatgggttcaatgaagtctacccttatgtaagctttgtgaccataagtagattacttctctttacccatttttaacgtgtttgttttttgttttttgagatggagtcttgctctgtcgccaggctggagtgcagtggcgcgatcttggctcaccacaatttccacccccggggttcaagcgattctcctgcctcagcctcccgagtagctgggactacaggcatgcgccaccatgcctggcttatttttgtatttttagtagagacagggtttcactatgttggccaggttggtctcaaactcctgacctcgtgatccgcccacctcagcctcccaaagtgctgggattacaggtgtgagccaccacgcccggccttgcctctcgtctttaaacaataaggttcaaagttccgtgggagcacaaaggagacatgatgaggacaacgggagtagggcctgagtttttttttgtttttttttttttaagcgttttgctcttgttgcctaggctggagtgcaatggcgagatctcagctcactgcaacccctgcctctcaggttcatgtgattctcctgcctcagcctcccgattagctgggcttacaggcacgtgccaccactcccagctaatttttttgtatttttagtagagatggagttataccatgttggccaggctggttttgaactcctgacctcaggtgatccacccgacccggcctcccaaagtgctgggattacaggcatgagccaccacacacggcccaaggcctgagttcttagcaggagtataaggcgcctaagcttagtctaccttctaaggaagcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtggtgaccagacttgtctccaactcccggcctcaagcgatgcttccgcctgggcctcccaaagtgttgggattataggtgtgagccactgcatactggaacacatactttatacttgaatttttttttatccccttccctcctgctccttacctatacttggatttctacatctgtgccagggcagtgggatgtatccccactttccccatcagcttaccctccagcaaatacgagactatacccttcaatatccagcactcagggctcaaccatgtgttttgggagcaagggaatggggttcctctaggtcaggaatcggcaaactcagtactcaagccagatctggccagctgcctacaagctgataatggttttttttatttttaaatggttacattgtaaactgttatataagtacctgataatatcattaattttgtttcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtccctggtctgtggtaactttctcagctccccaacccatgtccctcaaagtcccctccctatagggcaagaacccagcaacttcgctctgccccgactctaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtgtgagtagccaggcccacacaggggcacatgaagggaaacaagtaccagaaaggccagtcctgcataagcctgctaggaggtgggtggggcacccagggcagggttgagggtgaacaggatgttacaagagtgcccaggccatgtggaacctgcccactccccacactgaggaggggactgagggtgacaagcccagggccccagaagacagtacctaagatgggctggagtgaggaagggaaactgattgcaaccacctatggggctgcagacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtgg

SEQ ID NO: 178363 - DNA, 1024 bp, Homo sapiens
  Payload ID: 15101
  Gene Symbol:
  Gene Name: RP11-644F5.10
  ENST ID: ENST00000551946
  CDS Start-End: 17-181
acagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgaggggtacagggctctgggttccaggactaacagcagcccactcaacaaacgtgggccagcagaggtggttaagatacagcacattggaatagttaagaagagacagtttagggctagacttcatgggttcaatgaagtctacccttatgtaagctttgtgaccataagtagattacttctctttacccatttttaacgtgtttgttttttgttttttgagatggagtcttgctctgtcgccaggctggagtgcagtggcgcgatcttggctcaccacaatttccacccccggggttcaagcgattctcctgcctcagcctcccgagtagctgggactacaggcatgcgccaccatgcctggcttatttttgtatttttagtagagacagggtttcactatgttggccaggttggtctcaaactcctgacctcgtgatccgcccacctcagcctcccaaagtgctggg

SEQ ID NO: 178364 - DNA, 1792 bp, Homo sapiens
  Payload ID: 15102
  Gene Symbol:
  Gene Name: RP11-65B7.2
  ENST ID: ENST00000627615
  CDS Start-End: 1-472
gggaagaaaggagcctgactcttatgatggaataaccacaaatcagagaggagtcacaatagcagctcttggtgcagactgtataccgatagtttttgcagatccagtcaaaaaagcatgtggggttgctcacgctggttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggtacatctttcctggaactttttcatgccaacatccatactttttttcatattgctttggctattgggaaaataaactcttgctctcttttgaaaaatatttttcctaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttggattcttcttggctatcacagtttctcagactttatttttcatgaccttggcagctttgaggagcactggccagatggtgagaactggtctgaatgtacaattcagtcttactgttttccatcaaggtgtcaccaatcttccagtctcccaggcagaagtttttgagagacaaatggatggaaaaactttttggccctcttccttaggatcagaagccctttggacttagactgaagcaagttaccagcttccctggttctccagcttgcaaatgacctatcatgaaacttctcagcttcaataatcatagcttcaaccagcactactacttgaggacctatgcagtgtttgtccatgagcatggaatgactcatactggcctcagagttagggactcactttaaaggaaaggggatgcagtagtgggcacatgactaagaaatccaccgatcctctcatatactgcaccaccagaagctgctggattagcagagcaaaggcaaagattgaccagaccaagccctgagacacagtgttgagagccaagacataaagttgtgaagattcagacccagagcccagcagggcacaggctggaggggtgatgtgagtgatcagtaacaccatgaagactctgctcctgggtcaggaatgcttttttgtccctgtttttggattttccaccatgatcagaaagaaatctaaaggtgaaggaaaggcagcgttcagcactgagcaagtccatgttggagaaaggataaatattctcaaagattcaagctatgaagaccaaatctacagaagatagcaactcattcacagggaattggaaatccttgtcttcgtggttcctggctcagcaggacccctgtggggcctctccctctcttgggaaagagattgctctagaaggtttactacaccagtgaggagaagatgagcgcaagggggattggccggctgagggcgaaatcaagactggagccaagtgcgctgagctctcacatgaggtcctttgctcctgttccctggaggc

SEQ ID NO: 178365 - DNA, 580 bp, Homo sapiens
  Payload ID: 15103
  Gene Symbol:
  Gene Name: RP11-691N7.6
  ENST ID: ENST00000531074
  CDS Start-End: 1-55
caaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctatgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagcattacactctatgtaatgggagtggggtggaggaagagtctcccaaggtggttggatctcactattctactggaagaggagca

SEQ ID NO: 178366 - DNA, 518 bp, Homo sapiens
  Payload ID: 15104
  Gene Symbol:
  Gene Name: RP11-697E2.12
  ENST ID: ENST00000622269
  CDS Start-End: 1-314
gattccagaaaattcggaggcaaatggaggcgcctggtgccccgcccaggaccctgacgtgggaagccatggagcagatacggtggcatttttcaactccgctggaaccagtgcccaggaggagcaaaggatgtgctgccagcccctggctcacccagtggcctcgtcccagaagaagccagaagcagcagccccagccccagggactgggggaaagtacatcaccccatatgggagccaggggacagtgccaaagatgcggcaccgggaggaggaggagatcgtcaggctggcccaggaccgggaggagatgaaggtactctgcataacaactggttatgatcagggccaatgactccccaccacttcccagcagataaggctcaggcattgaagcagagagtccctttgggccctgaggatgcaggaagtacctgcacccacctaagacctccatcattggttcatccaaactacttcctaatgtcagaataagaaacaagtctcttttgggctca

SEQ ID NO: 178367 - DNA, 3838 bp, Homo sapiens
  Payload ID: 15105
  Gene Symbol:
  Gene Name: RP11-697E2.6
  ENST ID: ENST00000561573
  CDS Start-End: 265-918
agaggaagcgctgccccggcagccgcagccacggccaccgggagctaggagtgaacccctgcgggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgaagaaagtcatagccccagttgacacaggcgacttagaagctgggaggaggaagagaaggcggaaacgcagatcactggccatcaacctgaccaactgcaagtatgagagtgtgcgtcgggcagcccaaatgtgtggcctgaaggaggtgggggaggatgaagagtggactctgtactggacagactgcgctgtctcactggaacgagtcatggacatgaagaggtttcagcccctcctcattgatggcttcaagtttgatatgcgagtctacgtcctgatcacatcctgtgaccctctccggatcttcacatatgaggagggcctagcccgttttgccaccacgccctatatggagcccagccataacaacctggacaatgtctgcatgcacctgaccaactatgctatcaacaaacacaatgagaattttgtccgggatggcgctgtgggcagtaagagtatctgaatggaggtacatgtgcctgttttgaaatccttggttttgacatcttgctggaccacaagttgaagccctggctgctagaggtaaaccactctccaagctttaccacggactcatgccttgatcaagaagtaaaggatgcacttctctgtgatgctatgacccttgtcaacctccggggctgtgacaaaaggaaggtgatggaggaggataagcggcgagtcaaggaacggcttttccagtgctaccgacagccacgagaatctaggaaagaaaaaactgagtcatcccatgtggcaatgctggaccaggaacgatatgaggattctcacctgggaaaataccggcggatctaccctgggcctgacacagagaagtatgcccgcttcttcaagcacaatggctccctcttccaagagactgctgcttccaaggccagagaggagtgtgccagctgctgccgggacagctggacaccatgaggcctcaagaaattgtggaagaggaggagctggagcggatgaaggccctgctacaaagggagactctcatccgaagcctgggtattgtagagcagctcacccgtctgcagcaccctggcccccagggccagaaaaaacttcatgagagtcgggtgagggtccctgtgaagtctcccagaggaaaagggaacaagggctgtcattccaggacatggtgttggtctcaacaaaggaggcttgtgtgatggtatctgtcagtggagcctgggaaagcagagtgcgctagctggaccttgggagagggtctgttgattccttttgcgtctgttcccaagctcctttgttttagatatgacatccagcaagttgcagctccaaaccttctcatttacaggaaacttgctctctatattcctgtcccaaaataaccccacactcatgactgacaaataacaagcccaccaccctcagtggcttctgtataattttctccctagcactgccagtgccccagctctaatgggagataagtaaacagatttgggccaacaaaagagctgccgctttcactattccctgggctggtagcaaacctgttgggtcttctgtttttgttgaaccccaaaggagtatctggttaaatagtggccgcggcctagaagagatttttttcagttacctccttcttccaacgctccatccaaacttacataaaaatgtggtaaggggctgctcttctcctctagcctagattttgctaggacaggctgggcagtcaagaactgaaatctatgagtctggtcctactggtgctcctaagaggggctgccacagagcagggcgctcctcatttcctgcatccagttctgccccatgaatcaatccccaggatcttaggggcactgccaagcatgaatgctgcaatcccacatgttccccggtaccatctgcagcccaagaacttcaactggacaggagagccggcagccatcaactcctgttcattgtcaatgaagaaggctgggaggtgctatttttccagtgccagaatcaggctcactagccaaggacaagccagcagaaggctagaagccataaaccgagtcctggcaggatcagtgccacccactttaaccccaaagcagggctattttctgcaaccggaaagagtggcatctgactcatggactgaatgcaccttgccctccatggtaaactctgaacacagagcagccaaggttcccctctgccctgcgtctgcacccatgctgcagcgttccagagcactcctcaacatcaatcagttcagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagca

SEQ ID NO: 178368 - DNA, 1388 bp, Homo sapiens
  Payload ID: 15106
  Gene Symbol:
  Gene Name: RP11-717K11.2
  ENST ID: ENST00000512921
  CDS Start-End: 112-1269
gattcgtctagttaaaccctggtgttcctgacacaaacttcaggaaaggattttgcacttgtgcagaccgggcgagcagagtaagaagcagtaactattggtacttcagagatgaatgcattcttggatgacccagaatttgccgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaa

SEQ ID NO: 178369 - DNA, 947 bp, Homo sapiens
  Payload ID: 15107
  Gene Symbol:
  Gene Name: RP11-722G7.1
  ENST ID: ENST00000598087
  CDS Start-End: 91-228
aggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtctgactctgtggttcattctggtggtattctaaggaatgaaaagtacacaaaggtaccttttacactcaaacaaaatggttgaaggaaaacttttagcagattagtcctgggggaaaatactaaattctgtccaagtccagtggttcctgacttggggatggtaggtgctttttctttatagttggaatcacagagttagagaaccttgggagagaaggtcatgtggactaacctccttatctcagaatgaggaaatgaaaacacagggtctgaagtaatctgctcaatttgaataagggttggaattc

SEQ ID NO: 178370 - DNA, 2286 bp, Homo sapiens
  Payload ID: 15107
  Gene Symbol:
  Gene Name: RP11-722G7.1
  ENST ID: ENST00000620307
  CDS Start-End: 73-315
gccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaaaaggagtctcgctctgtcgccaggctggagtgcagcgacacgatttcggctcactgcaaacttcgcttcccgagttcaagcagttctcctgcctcagcctcccgagtagctgggacctcaggcacatcaccaagccaggctaaatttggtatttttagtaaagatggggtttcgccatgttggccaggatggtctcgatctcttgacctcctgatccgcccacctcggcctcccaaagtgctgggattacaggcgtgagccaccacgcccggcacctagttttcttaattggtcactgtcattttcttaaacttgtgaacaaatgagaacctaaaagagccaatctttcaagatggatcccagtggctaactgagcttaaatttaaaatagagccaagctgccacgtgttgactagagctaacacgtgtactacaaattccccgaaaacccacacctctatctaactttggaactttcagagctcacctgaagcaaccaaccagagctcacctgtcgctgccaataagggctcagctgtattgaccaaccagagctcaactgagtcaaccaatcagaactaagtttgaattgtttatttgcataaattgactgtactgggaacctcgataggaactttctctataaaagccatatcctctctttgttctctggaactgcacttttgttttacactgaagtctgcacctccctggtttgcaaactgtacacaggaatagcctctttcctccaaattcctttacaaagaatttttcttcacaatatgatgcgagaggtagaagacatgcttacagctgtggattcatatcctgaaatcaccacgattacaataaaacgaaaaatcaaacaaagaaataaaaagtagacaaaaacctcaaactaattttctcttcaatttacaaggctgaacagctaggaggagacttattgattcaggacagttcacctgctcacattttgagccaatggctgaggcccaggactggagatacttcattagtttagccagtggagagtggggtttggatgctctcattggatacttctatcataagtgatgcatactcataggggttaagctttgcattaaaaaagattgtagactgggaaataatataattagacaaatgtgaatgacttagagcagttatttcagtttctaggaagcttaaaaagggttcattgatttatttgactcagctatttctgcactgtgggtttttgttatgtgtttaaatgaattctataacagaggtaatgttgaaaaaagattgtatgaggtctgcttgttccattagtaatgtttgtcccagttcgatccttctgaatttttatttatagcagtaaactgtttccctgtgtgtgcgtgtgtgtgtgtgtgtgtgggtgggtgtgtgtaatgtaatttaattactagtatttcaggtatgagttttgtaaccacatttataaatgagctgctcatatatatacatatacatatatatatatgtatatatatatatatatatatatttagtatgcttccttcaatgggtatcaacatcatattatattttcttgaaataagttttgtcggctgggcgcagtagctcatgcctgtaatcccagctccttgggaggccgaggcaggaggatcgcttgagtccaggagttctacaccagtctggggaaacatgatgaaaccacatctctacaaaaaaaaaatatgaaaactagccgggcgtggtggtgcgcgcttctagtcccagctactcgggaagctgaggcagggaaatcacttgaacccaggaggcagaggttgcagtgagctgagatcgcaccactgcactccagcctgggcgacagagcgagactctgtctcaaaaaaagaaaaagttttctctctttaaacctggaaccatcttactagcaataaatgacctgatcttaaaagtctgacaggaaacagcattggaatttgggatggtaccttcttggtgattgctatttctttaattcttcttaatcgctaaatccttgtttggttcagtttctgggatttatgttttacattcatatatttaataaatgtttctgaatgtattatcataga

SEQ ID NO: 178371 - DNA, 1935 bp, Homo sapiens
  Payload ID: 15108
  Gene Symbol:
  Gene Name: RP11-724O16.1
  ENST ID: ENST00000513963
  CDS Start-End: 75-1709
gttgccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaac

SEQ ID NO: 178372 - DNA, 1228 bp, Homo sapiens
  Payload ID: 15109
  Gene Symbol:
  Gene Name: RP11-729L2.2
  ENST ID: ENST00000590722
  CDS Start-End: 105-365
gcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgaaaacaactggtatttctcacagctccttctagatttggacaaaggaatgatacaagagcaggcaatacatggtccataaatcaaaatactataaaaaggtatacagtgaaaagaagtgctcccacccctgcccccattcccccctacctcagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactg

SEQ ID NO: 178373 - DNA, 732 bp, Homo sapiens
  Payload ID: 15110
  Gene Symbol:
  Gene Name: RP11-736N17.11
  ENST ID: ENST00000634353
  CDS Start-End: 176-502
gggagagcgcggagccagcggagcgcggaggccccagcgccagcacccgcgcgggcggtgagcgtgagtgtggcgcagggtcgcccctccccagcctggccccggcagtgcgggccccgggagcgccctgacggctagtcctcgtgcagcttagtggcgcagtggcggcagcagcatgagcaccccccggcctgctccaccacagccaggcgctgctgagggggctggaggcccagaagggaaggctgtggcaggtgcctgggagaagggccctcggctgggccagcggctgccctcaatcgtggtggagcccagcgaggcggaccctgtggaaagtggggagctgcgctggcccctggagagtgcccagaggggcccctctcagagccgggctgctgctgccccctcgccgagtctgcccggagaaccagggaaagctgcagataacgctggcagcgagtgtgcctgctccgaggacccagcagccccggcccggggataggacaaggacgtggctgggctctgctgtctgactgctgagggcctctgccccagggtggccgggctgatgcacaggagggccgggcctgcccagcctggaaagcccagaggctgcttcctgtgtcacagggtctggaccgcagccctgccctcttctgcccatggcccaggtctggatcacaccccgctttgttccgtggtttgaagcagaaataaaggcacttcctggtg

SEQ ID NO: 178374 - DNA, 2505 bp, Homo sapiens
  Payload ID: 15111
  Gene Symbol:
  Gene Name: RP11-73M18.2
  ENST ID: ENST00000472726
  CDS Start-End: 2-2200
aatgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgatt

SEQ ID NO: 178375 - DNA, 984 bp, Homo sapiens
  Payload ID: 15112
  Gene Symbol:
  Gene Name: RP11-745O10.4
  ENST ID: ENST00000539652
  CDS Start-End: 35-541
gtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcaggccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggc

SEQ ID NO: 178376 - DNA, 983 bp, Homo sapiens
  Payload ID: 15113
  Gene Symbol:
  Gene Name: RP11-761B3.1
  ENST ID: ENST00000422269
  CDS Start-End: 1-131
agtccgagtggagagagcgagctgagtggttgtgtggtcgcgtctcggaaaccggtagcgcttgcagcatggctgaccaactgactgaagagcagattgcagaaaccagcccaaaagacttcctcttttgaaagagaaggatggtggagaatagcattaacagatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattcccatctacccccacccccaccgcacaggtgcctgatgccttaaattccccagcttttcttgtgttctgtggagcaaatcagcttgcttctccttcgcaagtcctctgcaaggatttacgcttctgccttctctacactgccagcatgaaggccctggtccaggtcattataatgtgaaaatgcctccaacaagctctgtcacttcttgttttcaatccagagtccctcgattcttgcccagctgttcagggcatttggggagagaagaagctgggtcacatgccaggaatgcttcagtaactgcatcccaggaattaccaaattagccaaagctcatgcagagccatctccccactactgctggggtgcctgacagggagaggttctggagagcctggagctccctcaccaagaagaaagcatgaggaggggaggggctggggaa

SEQ ID NO: 178377 - DNA, 1807 bp, Homo sapiens
  Payload ID: 15114
  Gene Symbol:
  Gene Name: RP11-762I7.5
  ENST ID: ENST00000546837
  CDS Start-End: 1-1570
tccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaacttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaa

SEQ ID NO: 178378 - DNA, 805 bp, Homo sapiens
  Payload ID: 15114
  Gene Symbol:
  Gene Name: RP11-762I7.5
  ENST ID: ENST00000550124
  CDS Start-End: 1-336
gaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaatctttgcagctcctacctgccagctcagatccccgtccggctatgggcgcggcgccggctaccacacctgaagtctccaggaagtaacgcctctccttctgcccctttcctattggaggaacagaatcagcgctgccaccacccattggttggtggtctgtaatgcagaagcacagttggttgccatttctgtcgttcgcaagatacagtgcccgcccctctcccagttccaccttttgaaagaggtggggcaagctgcctagagaagtgagagcgacgtcagctattgaccaatgggaagagctgatggtatggcgtgggagcaagagtgacaacgattggtcagccttgcatctctacgcctaaggcgggagctcctggaggcggaggccgcgggtgggggcctagtggagtgaggggtaacaagatggcgaccgagacggtggagctccataagctaaagagcacttcttaaccttttggaggtcacagatatctttgaaactctgatgaaagcttgccgaactaaagcaagaatgtcttgctcgtggtttgg

SEQ ID NO: 178379 - DNA, 646 bp, Homo sapiens
  Payload ID: 15114
  Gene Symbol:
  Gene Name: RP11-762I7.5
  ENST ID: ENST00000546813
  CDS Start-End: 1-518
ggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaatcctctgtttcagtgccttccccatgcccatggagctgtcccaaaacccatccctcagtatttgttgatgccaaagacacgaaccccatggaactggggcaacttcggcagcagtacacttagcaatgaggctgtgttgatgaggaagtgcgcagcatcatacttggtatagaagctggccaggagatagctggggagagaaaaaaataggcttgccgaactaaagcaagaatgtcttgctcgtggtttgg

SEQ ID NO: 178380 - DNA, 782 bp, Homo sapiens
  Payload ID: 15114
  Gene Symbol:
  Gene Name: RP11-762I7.5
  ENST ID: ENST00000548593
  CDS Start-End: 1-366
gctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaatctttgcagctcctacctgccagctcagatccccgtccggctatgggcgcggcgccggctaccacacctgaagtctccaggaagtaacgcctctccttctgcccctttcctattggaggaacagaatcagcgctgccaccacccattggttggtggtctgtaatgcagaagcacagttggttgccatttctgtcgttcgcaagatacagtgcccgcccctctcccagttccaccttttgaaagaggtggggcaagctgcctagagaagtgagagcgacgtcagctattgaccaatgggaagagctgatggtatggcgtgggagcaagagtgacaacgattggtcagccttgcatctctacgcctaaggcgggagctcctggaggcggaggccgcgggtgggggcctagtggagtgaggggtaacaagatggcgaccgagacggtggagctccataagctaaagcttgccgaactaaagcaagaatgtcttgctcgtggtttgg

SEQ ID NO: 178381 - DNA, 10086 bp, Homo sapiens
  Payload ID: 15115
  Gene Symbol:
  Gene Name: RP11-766F14.2
  ENST ID: ENST00000511828
  CDS Start-End: 1-5382
atgctttcctttcatttctggaagtcccggggtcaacctacagatgctgcttcttccgtggccgatggcattcagactcctcgctgctgccgacggtgccaggcaaacaactggacaggacagctcagctacagaacactggccacagtctcggccggagcagcagccccccagccacagaccacctccaccgcctcatccaggagccttcccacctccctcaggcttgctgcggccccgccacaggggctgaagaactgggaggtggtggcagcagtggcagcagtgcctacagccttggggccagtccagatacgtgggaccctgcttcgggcaactctgcagcccctccggggccagagacggacccaagacttccccagcgatcaccattgtctcttcctgtcgctgaaacctgggcaagggctcataatggaagctgcccctcctgagctgaattcgaaagcaagacaggcggaggtgggggacggggtgagcagtgctcaagacagccaggagctcaagcagcagctgtggccacttcccaagccttcagcctcctcccagcgagaagcgaaatatgtggacatgtgtgcttcagctgaagtccagagggagagtccccagaccatgaaacttaccctggggcactgccctgggggtcagagggcctctaggagcccaaaggagaaagcccaagatgaacccagcagcaagactccaagcccccagaacaatcctgcctcctcccaactctctagatcccagcactctgcctctgaagagggtggcaatttctcatcttcctcatcctcctccccgatgaacaaagcagaagaggatggcctttccaaaatggaggactccaccacatccacaggggctctggccacctcctcttcatccttaggcttcgagagtgagagtggtgaaagtgaaggttgccaggccgtgggaggagaaggagagaaaatatcaggaggagggggaggaggaaaaggaggagggggaggaggggcaggagatggaacagagtgcagggacattattgccaagtcccagggcagcagggacccccccaaagtcgaagaggctcactacatcaccacccatgagatccagctgagtgaggtggaacaggacatggatttcgacgtgggactggcctcccgctgggatttcgaggacaacaacgtgatctactcgttcgtggattatgcttcctttggtggcagcgacgagaccccaggggacatcaccagtctgaccgaagaggacgacgacaacagctgctacctcagcaccactcccagcaccaacaccacccggacgcccagccctacaagcagcgacctggcccgccccaatgcaggccgcagtggccgcgacaccagcagcaccgaagtgggcagtggcccctctgacagtggccccactcccccacccactgggcctggcactgcccccctgactgagcccttgcctgagaccccggaggcagcttcaggggcagcagccgccgccgcaagcagctgtgggagtgcagcaagccagatcctcctatcaatcaaaccggcttcccgggctataaatgagcctagcaacgtgcgtgcaaagcaaaacattatttatgctgccaagcatgaaggcgacatgagcctccgcgtctctacagctgctgaacacaattcaagttcgctgaagcaaaacccggctgcagcagtggctcaggaccatgcaaagaaattcattgctgtacctgctcgcctgcaaaccaggtgcggggccatccgggcgaaggagctggtggactactccagcggagcctccagtgccgtgagcgaactggacgatgcggacaaagaggtgcgtaacctgacctcccgggccttccggagcctggcttacccctactttgaggctctgaacatcagctcccgggagtcctccaccacgctctccgaagtgggctttgggcgctggtcaactttcctggacttaaaatgtgggggtgttggggccagggtggagcagagcctcctcaggagcagcgcggcctctgtggctgcaggtctgaggaagggcagtggggcccgggccactgccgaccagctctacatccagtccaagaagtctcagaccaaggccttggagttcgtggtcagcaaagtcgagggggaaatcaaacatgtggagacgcccctgtgtttccagaagcaggtccagacgggctcccgcgtcgtcacccttttggagcccctgaatgtacgcagtgagagcaaagccagctcggcccctgggcccggcagggccaccaaaggccccggcaagggtcccgggtcggcatacacggacgacggctccgagacctccgagggcagcaagcccacctcccgcgccgatggcccccagaagtccaagttcgcctccagtctgctcaaaaatgtcatttccaagaagatgcagcgggaacacgagttcaaaatggagaggggagaagtcatggatacatcccaccacctctcaggcacctccaaggagacggagggcgcccgcgggagcgagaggcagcgagagaggggcctgcagaggcagagctctcgtcactccgaggccggctccgagtacacagtggtcagcatgtccgacgcgggcggggaggggtccgtggcgggctccaaatctccagtcttcaaagccagtactcctcgcgagcgcaacgcaggccctggccggaatttcaccgatggacacacagaagtgtgtgaaattaaaaagagtgcctcagagaccgtcaagggcatcttcctccgtagtcagaacagtgcgttccggtcatggaaggagaaagaggccgagaagagggaggaacaagcccctatagggaagctgaagctgcccaaaggaggcgactggcgggctgatctcggggagatttctgccagcaagaacaccatcatgtctcgcctctttgtccccaacatccagcagacacccaaggacaagcagccgaggaagcaggccaccaagtaccctgctgctcaggccacctccacagcggtgatcagacccaaggctcccgaaatcaagatccggctggggagtgtgcagcagccgagctcagacttcaacattgccaagttgctcacgcccaagctggccggtggcagcgcctctaacctgttcaagaccatcgaggacaacagcagggcacagcagaaactcttccgcggggacaacctagaaaaagtgccccatttccaggtgagagacatcagagacaagtccaaggctcaaggccccctccaccaggtgagagatgtcaggaaactaattaaagggtcaggggatagtagtgacaagggcagtgttaccccagagcaggggctgactggacccaaacccaggcagctgtctgcagcagctggcggatctggatccctgtcccccatggtgattacatgccaggctgtagtgaaccagagggaagacagcatggaccgagagcccagggaaagcatgggcaaagggggcggcagcagagtcttgaattcttcctccccagaagggacagtcttggttcacagggcatctggcaggctgcctgtggctaccattgcccccaataagcccgagcagggctcatacctgcctgtgctcaagattgtctccaaggcttccacccagaagaccccagagaagctcaaggaggaggaggtcaaggaggaagggaaagccacgaagccagcccggaatgccctggagaagctgactgcagccgtgaggtccatggaagagctgtacagcttcaacaggaacgagtggaagcgcaaaagcgaccccttgcctatgatgatggacagccacgtgctgtcgctcattgccagtgaggagagggaaggggtagtggttgctgatggagaccacgacaagctgtccaaacggctgggtgaggtggaagagcggggcacaggaaacaaagctggtgtggtcctgcgaggggcccccatagaacgtctgcagcggagaaactccaaccccagcgctgagagtgtgtctgccagggcagcggcctttgagaacctggccagggaaagaccccgatctctctatattcccccagtccacaaggatgtagagagaacccaacccctgcagcccctcccaccactccccagcaaccggaacgtgttcacagtgagtgccagcagcatccagaaaactgggggtgtcgctggcaagttcccacaagggccttctccggagagtccttcagcagctaagggcatcaagtcgcagggactccggtccctcaagatctctccagccacccgggcacctcctgatgaggtgaccaacaggaaaagtggcagcaatttggagaagagcaacagtgactgtgagaattacctgaccatccctcttaaaggaagctctgctgcaggggagcttcttagcaggcctggggcttccagggaggggccccccaactcctcagctgccactctctgtagtttacccccgctgagtgcccgcagtcaggtccccagtagctccaaaggctctcaggttagtggaaccagccgaccagcttggcgtaccaaacctgacaacccccgggagacagtagctgcccccccagggccacagagccccgagcatccccccaccaccatctaccaccagccgccgctgcccttcaccctacagggggcccagcctcaggtcctctgcttctccccacccagcatgcctgccccagcacctgcagcctcagctcccgtccccacagaccccttccagcaggcacagcctcaacagacccagcgtaagatgctcctggatgtgacaacaggccagtactatctggtggacacaccagtacagcccatgacccggagactgtttgaccctgagacagggcagtatgtggatgtgcccatgacctcccagcagcaggctgtggctcccatgtccatctctgtgcctcccttggccctgagtcctggggcttatggacccacctacatgatttaccctgggtttctgcctaccgtgctgcccaccaatgctctgcagcccacaccaattgctcgcgctccaagaggaagtgagctctccccaatggtggcagaaccttccagcaaagaggcagctgcaacgttcaccgaggccccatacttcatggcttctggtcagtctccggcctcctcaacctcctcagccccagcagccacatcccagctcctaggggccaaggcctttgcccagctgcatggcaagcctgtcatcagcattacttcgcagcccctggggccacggatcattgctcccccttcctttgatggcaccaccatgagctttgtggtagaacacagatgatgagcagccaccaggaagcggaatgaaaaactgctggagcaagacaaaaagatggactattcttctttaatctggaatttgcattgtaatagcactaagaattatttcatctgaaaaacttcttccacatgtgttattcttaatttttgcttcttataagctaagtgtgtaagtttctatatttttctgaacaatcctcttaaggcagtttttattttaattttattaagttgattgaatggttgcattttttccctttatgactatttctttttatacttcaacacaggatataagctttctattcacctccttcccccctgtacttgtgactagacaaacaattcctttgttcccattgttcagtcaaaacataccacagaatgggattgattctgttgtaaaccaagctagtaaatgagtaatttggatcacgaatctccttatagtttcttggaatatatcaagactagctggctgagttgtaatacgtatttaagttttcactatgatggtctgctctttgaatcatatatcagccaaacctacccattctcttggttatgctctatatgttcttttattaggtttggcatgatttcaaatgtgattgtgaaaaatggtggttgtaatgtttgtgctttattttatttttcccatttgtacaatgccacgacactatttgttgccttaaaatagaatggcttgaaatactggaaagccaatgattgcatctaaaattaagtacttagtctcagaaaggtataaaatatctattttcctttaagaatccaattatttttgtgggtgcataacatttttcttttcttcaataattccctccatagttgcatactcgtgtctctcatggattgtttagagtctaaagagtgacccatttggggcagtagagtagaatatggcactaattcagtggctctgattcactccagccctagcctcgctatcccaataacagtaacctagagttacagcacttgctccttatgaggatgaggcaggtttgaagagatgtcaagaatccaaatcacagaatcttttattgacatttagtactgtctcagttgtaacccaattctgaaggctatttgagtgagtgttcacagggagtcttgaagactggaagacttgattgaacagataaatatttagcttgtcataataagtgtatcgatatatacttggcaaatgttacattgaaatattacttaattactttttaaaggaataatttgaaggttttcccaggatttttttttaagaatctccttttatttaccaatttgtttaaagataaagcattctggtaattttttaaacaccctaatattattttaaacctcagcaatatttgatttctgcttaaattttcttcataagccacagaattttatgctactcatgacaaaaagtgtgagtaaaaaactaggagactgagttttgtatgatttatataatctttttactttgtagttatgcttcccatctcagactcttaaaaaagacttaatttcactttcagggccttcctttaagggatcttactctgaaaaaaagttctcttgggtatagggaaaggtttgaggcgggaatagtcagctctgatcacgattcaattgcttgttgtgctgatgagctatgaaatgaagctatagactttatgagacatgaaatatgaaacatagtctctgtgtataaaaaagatgcccttgtgccaaattcaagaaaaagatatttctttatcatagaggtcttcttacccaggcacatcaatcaattccccccagaacttaaagtaagttttatccactggggaacaaatcttatggcatcagagcttcctcgttttcaggagagattggctgggtataaggtaacttaatattgacccaagaaagtagaatccctttcagaaatcttacacttattttactgaaagcagcaccaagaaacctccagtatttgaatacacctggtgaaacctatataggatttgggtggatagtaccaaaattgttaagactggtttaaagccaaatgcgactttcaggaaaaaccagtggccatgttgagtagtgactgctcaccaactcttccaaaagagagacaactccttctctagaaaatgtggtagagttgagggcttgggacccctaatctatgtatcagtgtttctcaccagcagatttgagttttaaattctcacactgaggtaaattaggacacaaactaaggaaagaaagaaaaagcttttcatttgtttgttctatacaagaggcttcaccttttaggaagttgccaaggacacagtgatgtccaagtggctaaaaacgcaacttttaaataatgttctattaatatcatgtcatctatcgataattttatggttctctatttcaccaaatcatacaaagctgctaggccattcactacctccagtgatagggaaaaaatattttcacgggcatgaggtaaatctcaatcttgatttttattgttttgtcatttcttgaggttgcatgaatatttgaatgaagtgatatacccttccttttatagctcaaggggaatcaaacaagagcctatgaagccttctgacccataaaactattaccctaataatgtccctttagttactgaacttcccttttattttttattactataaaaccattagtaaaacatttcctaaatagtgccttgaacttgaatctaatcagaattgcagagtctggcttttataatatcctcttagggttatatgtgtggcttagttttccagaagatccactttttacttgttgataaaatggtcatatttgaaatatgtcccatttcaatcatttctggaaaactgaacacatgtgtaaccgtataaaaatttaattcgccagaatgtatgtttttaaaaagtactcaatgaagttgccctcaggattaagtgaaggcccagatatgtaggtaatgacatagcagagaggctctctatatgtccatttatcagggagtaaataagctaaagcaaatcacactttatatctttataacaaatctcaactattgacatgcatttctaatacatccttatgtcactggaaatatctggtgatataaattcctttttcttattttcaaatttgacattatcatccttgcctcttaaaaagatagattttaattgttttcatacttcatagaaatcaaagtctgtgtttgctacaaattgaatgctcacgttacctgaaataatactttggactgcaggacaggacagtattgattcctaagtagattgactataatctcatgataagtatgtatatgtgcatgggaaaacaacattcaataatagtctttgtgtttaaaactatcatggtatacattttcttatgtggtgcttgaggagtttcattctacagtttacaaggtgtaggtttgcaccccaaattctcagggtatgctatttcacccaaatacttgaaagaaaaaggtgccctgtattttatcagtactgttgagggggaaattttttgtgtaagtttgtttgataaaactgcttataaaaatcaaattcacaaaatatgttaggctttcacataatttctaaggagatatatgtagaaataagatatatattatcaagagactgcttatatattcttaactagcttctgggtcctaagtagacctcacaggtgcataaaatcattaataaagcatgtagcacttgctaattggtgccttaagcttgaatctaatcagaattgcagactcgggtcctctgggaaaaaaacatgtccgtctgtggcacgtgtgagtactaggcccaggggaagagtctgaaaattgaattcttttgtgtgtcctgtgtctcagaagagaactgaatgttcagagcagcgtttgtaagctattaacattcagtatttcgtgttgcaactagaacacattattagatttattcctgtttaattcataatggtgcagaataaaacacacacatctgatttgatttctttttctttttttaagtttcataattgctttttatggctagtgttaatggcaaaaagtcctttccagggctccctgaataatctaccatacctgtatccatagcaggtgatgcttttttttatccccactttgaagacgtgtgtttctgtatttacacataaatcatactattgtatattaaagacagcagtggttgaaaagaatgtgaacactgtagaagttatgttggaaaaaaggagagtaaattgtgtgattaatggggaaggatattggataatgttataccccggactatgaaaaaagctggtggtaaatgggaagaatgtgaaattttaaactgctctcaacgtaggaatcttggtggaaaagttcctacctgaggtctgatatgattcaattatagaatgcaatgagcttggccaaggggactttgaatccagccaaggaaactttgaatctcgacagctctgagaatcacattttcagtgcattgaatatggagtaaactatttagacaaggattctgtgagactaggctacttacctttaattgccagcatttgtaaatgattgtgcaatcttgtgtaatggtcttttattttgactgttttggaaaaaaaatgttttattgtttttttttcccagtaaaaattacttcaaagaaaa

SEQ ID NO: 178382 - DNA, 530 bp, Homo sapiens
  Payload ID: 15116
  Gene Symbol:
  Gene Name: RP11-77K12.1
  ENST ID: ENST00000567194
  CDS Start-End: 107-530
ggaccccggctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaa

SEQ ID NO: 178383 - DNA, 254 bp, Homo sapiens
  Payload ID: 15116
  Gene Symbol:
  Gene Name: RP11-77K12.1
  ENST ID: ENST00000566594
  CDS Start-End: 1-254
cagcagatcctgagcctgaaggttgtgccgcgggtgggcaacgggaccctgtgccccaactctacttccctctgctccttcccaggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgc

SEQ ID NO: 178384 - DNA, 2125 bp, Homo sapiens
  Payload ID: 15117
  Gene Symbol:
  Gene Name: RP11-77K12.7
  ENST ID: ENST00000460606
  CDS Start-End: 1-173
agttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcctgc

SEQ ID NO: 178385 - DNA, 1609 bp, Homo sapiens
  Payload ID: 15118
  Gene Symbol:
  Gene Name: RP11-793H13.10
  ENST ID: ENST00000591834
  CDS Start-End: 51-1442
agaggcttgaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttaggaggaagacagcgaacccctcccaccacaggatgcccagacctctgggtcactgttgcactacctgctccaggcaatggagagacctggccggagccaagccttcctgtttcagccccagaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttct

SEQ ID NO: 178386 - DNA, 1032 bp, Homo sapiens
  Payload ID: 15119
  Gene Symbol:
  Gene Name: RP11-795F19.5
  ENST ID: ENST00000562771
  CDS Start-End: 112-285
cctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaagtggatgaagacctgatcattgaagttcaccagttatttttctcaagaatgtgaataacaatgggatttgcactcattatatttttagaatggcttcgcataattttcatgcatcctgtggacgatgaacacaaatgcagctgtggccgtgcctggcctgtgtgtgttgaacgcgttcctgccgtgcgggagccacctacccagcggagcctcagagtctgagttctcaatgagtcaacattttgggtgtgtatgccaagaggtgacacgaaacagaagttgggatcactgtggttaacctgagcatgttggagaccaaggagaggctgatgttaatgttggatttttgtgaaaatgattcctttcaaagaaagacctgtgacagttgagcgtgtgctgcatctgagatgctggctggggagcccaggcagtcgacgggagaggagcgctcactgtcttactggaaacaagctgtttggagaacaacctgtttttactctccttttgcaagcaaaacactcccactgagcaatagcgtttatggcagcatttagcggacacagaagcacatctgaaagtggagagagacgcgtttccccattgctggccgagtcccaccactttgctcagctatgaacacctgacatctcgtttcattttcatgcaaaatctggagataattattatccacaattctaaggccttaggcccctccgcatgagcctgccattaccacttcattcccttgcacctgaaagactcc

SEQ ID NO: 178387 - DNA, 852 bp, Homo sapiens
  Payload ID: 15119
  Gene Symbol:
  Gene Name: RP11-795F19.5
  ENST ID: ENST00000591514
  CDS Start-End: 1-174
aaggaagaccatgcgcgcctgagggccctgaacggcctcctctataaggcactgacagacctgctgtgtacccctgaagtgagtcaggagctgtatgaccttaacgtggagctctccaaggtggatgaagacctgatcattgaagttcaccagttatttttctcaagaatgtgaataacaatgggatttgcactcattatatttttagaatggcttcgcataattttcatgcatcctgtggacgatgaacacaaatgcagctgtggccgtgcctggcctgtgtgtgttgaacgcgttcctgccgtgcgggagccacctacccagcggagcctcagagtctgagttctcaatgtgagcctcattttattttattttaaaatgcagttgtaaactttccccttaaacaattcagaaagcagcagtcttatgtggtcttttagaaaacaaactcaaatggaagagtgtccttgtatattaatgaacaaaatttacttctgaatgtgagtttgtttttggtgcttggaaccagcacttcatggaagagaacagcaaaaagtgagcagcagagagatggtggtccaaggagttaaaagttattttaatcacagcgggcaacttgggaagagtttcatggtgtcagaagtctatatgacaggaagggaagagagtacctcaaaggaggaaggaaggagagaagatgtggtaggtgaagttgtaatgtgatttaatgatggctgagaacttgtacaaaacccagaaaatgaagataaattagatatgaaggaagaaaaaggtcaaagatgagattgtaaaactgtgatacagactggctgaaattggagtttgggtctt

SEQ ID NO: 178388 - DNA, 2218 bp, Homo sapiens
  Payload ID: 15119
  Gene Symbol:
  Gene Name: RP11-795F19.5
  ENST ID: ENST00000569722
  CDS Start-End: 151-324
atcgccccgcccacacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaagtggatgaagacctgatcattgaagttcaccagttatttttctcaagaatgtgaataacaatgggatttgcactcattatatttttagaatggcttcgcataattttcacaatagcgtttatggcagcatttagcggacacagaagcacatctgaaagtggagagagacgcgtttccccattgctggccgagtcccaccactttgctcagctatgaacacctgacatctcgtttcattttcatgcaaaatctggagataattattatccacaattctaaggccttaggcccctccgcatgagcctgccattaccacttcattcccttgcacctgaaagactccagagccccttgaaagaacaggtcctccaagaggagcatcgccagccagcccctgaatctcctgaggaaactctcatgcacatatcttgacctgagcacagaccggacgccagcggagggcaggagcaagcaggacacactgtggctgaggaggggaccctgggcttgtgggcctcggagaggcagagcaggggaggcagatgagactgcacacagctttttgtttgacatatcctaagccccctgcacacgccactcaaggtcttctctgtgccccatctggtgcaggaggcctgtctgtctgtgaaattgcttttagcaatagctgtggatcaccactgagagggtgaatatacaaatgaacaatgggcagaccgtctatgatggcaaaacttggacctccaaccttgaggccaaagcacatcatgtgcggcctctggcgggactcaggtctgggaagcgactgcagcttccctattttctagctctgcttccaactaagaaagtcagatattctccccaaaccaaccccataggatgcccgctgccaggtggcccacccccagcttccccctgacaacagcctccacccagggcatacccaaccagagccttcccatcttctaatgggaagcttcccctccccaccccaccttcaaggctctgccacgcgcagggacagtgtagccttcttggctacagcttcgagtgagcagcctctgccatcctcgctgatgtccccggttaccgtgaaggctcctccaggacactgtctgcactgcctgtcgtccagaccccacctctgcccaggcaccctggccttaatgctgcagcccacagggcacccagctggtgactgaggcctgttctgagcccctcgctggcacattcctggacttctcagtttggtgccagggcctcattcctgcttcccatttgctctgttacaggggaattagtcccttcctttactcttttgtgctgtgctttctaaacgtggtgtttgtcataataagaagcatgaggggcacatggatcagcctcacagacaggtgagtctgtagctcttaccagacccttgttcacatccatgaacttggctgtggatcaccagggaaactgggtgaggttctgccatccaggggttttgtcctgagaacttggcttttagaacattctctctggttttttgcttgggggtgggggtctggtgcagggtgctgggtctgtgtttggaggaggccagcccgtaggctgggggcctgagacactgtgcactggcgtgatgcgtctgccgcccatcaccagcttgcaggggcatccacggctgaatcctctgctcttccaggaaagacttatgcttctcatggtcctagttctcatgctgatctttctacttggcaaaattcaccaagggtgacttgggtttttggtggcaactctgggaacatttggcttgaaaaattgttcatttaagagattctttagagaagaaaatgagtaagattccctaggcctaaatgcagaggcctccaaatgaatttctgaataaaaaagtatttcgctaa

SEQ ID NO: 178389 - DNA, 930 bp, Homo sapiens
  Payload ID: 15120
  Gene Symbol:
  Gene Name: RP1-179P9.3
  ENST ID: ENST00000467125
  CDS Start-End: 1-930
aaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaagtctggcatagaagattaaagaatcaaaaaagtgccaaggaaggggtgacagtgcttataaacgaagacaaagagttggctgagctgcgaggtctggcagccggagtaggcctggctaatgcctgctatgcaatacagtatgtagctttggccatcattatggagcacctaggcaaaggtactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattc

SEQ ID NO: 178390 - DNA, 349 bp, Homo sapiens
  Payload ID: 15121
  Gene Symbol:
  Gene Name: RP11-812E19.9
  ENST ID: ENST00000569103
  CDS Start-End: 1-349
atggagtttgggctgaactgggttttccttgttgctattataaaaggtgcccagtgtgaggtgcagctggtggagtctgggggaggcttggtacagcctggggggtccctgagactgtcctgtccagactctggattcaccttcagtaaccactacatgagctgggtccgccaggctccagggaagggactggagtggatttcatacattagtggtgatagtggttacacaaactacgcagactctgtgaagggccgattcaccatctccagggacaacgccaataactcaccgtatctgcaaatgaacagcttgagagctgaggacacggctgtgtattactgtgtga

SEQ ID NO: 178391 - DNA, 577 bp, Homo sapiens
  Payload ID: 15122
  Gene Symbol:
  Gene Name: RP11-831H9.11
  ENST ID: ENST00000528405
  CDS Start-End: 10-309
atcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgct

SEQ ID NO: 178392 - DNA, 777 bp, Homo sapiens
  Payload ID: 15123
  Gene Symbol:
  Gene Name: RP11-834C11.12
  ENST ID: ENST00000513209
  CDS Start-End: 1-381
gtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggacc

SEQ ID NO: 178393 - DNA, 3087 bp, Homo sapiens
  Payload ID: 15124
  Gene Symbol:
  Gene Name: RP11-849F2.7
  ENST ID: ENST00000582471
  CDS Start-End: 52-375
ccttttgcggccatcaccgaagcgggagcgggtaaggattcggcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggattctgccctgcccctccgctctgcatctgacagctgggatctcgggatcctgttttcctaagcttgctggaattcctgcagtcctcatgtgaactcccctggcctcatcaccatcctgtcttacggctgttctgactaaggaatcccagtttagacaactgagtatcaagttctctccctaaggaattatctgatcacagtggcaggtagactccatttggggtatctcttttctgcaggataatctcctgacatatctttatgtacacagatataatatttccattggaaacagatcctgccacccctgttaggagtcatcaagcctgcgcccaagttcacttggactctgctttattctggaaagattaataaatgggctacagctctggcagcgtcaaaactggccagaccaacagacctcccaggaaagcaaaactcctttccctcatccatgaagctgtactcatcttgttagatgtgagacctatttcttatttcttccatttattcacctgactcgctttcagagtcctttatgctgcatgccttcattcctggtgccctctcttgtctcttccccagtcctgctgaagctgctctttagcccaggccccaagactatatggtccctgtggcagcagccaatgttgtttcaggaagcaacagcatttgaaaatatgaccaaagattggaattatttagaaggctctcaaaaggattgctacagagacacaatgctggacagttatgagaacacggtcccacagggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccaaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctcaaaaaaaaaaaaaaaaa

SEQ ID NO: 178394 - DNA, 5064 bp, Homo sapiens
  Payload ID: 15125
  Gene Symbol:
  Gene Name: RP11-864I4.1
  ENST ID: ENST00000496634
  CDS Start-End: 47-1624
gtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcattcgcacagctcgaggggagtgcgggggcagcaccgcgcgtggcacctggcacccgcgcagagttcctgaatggcagagcggtgggtggctccagcagtactgagaagagccaggtttgcctccacattcttcctgtcgcctcagatttatgcgcacaaggacggagatttgcgttcagcgttcttcattctctcctttaaacgaggagagttcatcccgttcttaaactgggtaagagatttcaaacctgaacatgggtcaaaagccatgaacatcagaagcgacgatgtcaggtcttccagcgtcagcccctccaggggccgagtccggaggaggtgggagggacagggcgcgttctccctcatgtccctgccctgcttcgggccggagggccggtgccctgctcgcagtaacagcaccctggagctgtcaggggttggatgtgagcaaacctcactttggcaggcgggttcagaccggggcccctgttagacgctcatccctttctggaggaaaagcagagcaggaactaaagggatttagcacacacactgccacctccgcgcagcagctgttcctcgctcccatgagtttcatagaatcatgtgaggggcttggcaaaatctaccatcaagtcacttgtccctgggagggccagagagggacgcccccagtagcactggccgcgccgggccaacaaccgcgccacgtagccaagaactcgcggcttttccagcgggttctcacaacttccccgccctccacgctgtctacctccacgtctagactccgattggcccgctgcacctggggggcgggccagtcaagagctccaatgcgcaggcccgagctttttccgcgctggccagcaggccccacccacccagttctttttccaattcagcgccactggataccgaactgtcgtacgtatgtcttctgtttcgtcctcgctttccggctgctgtttctccacggctctcctctttccccctcccttctctcccgggcggcttactttgcggcagcgccgagaaccccaccccctttctttgcggaatcaccatggcggctggggtaagtttgctggctctggtggttcgggtcatcctatccaccgccatcctttgcccgagtggggccagtcggcgccagaggagttctgaggttgagtggggaactgattcgggggtctacagactgtactgctggagagtagggttcctagggcctggaggggaactgaggctggggctctcggaggccagaggtggaagggtctggggaagaggagaaaagagatgccgggtctgggccgtccgaagcctgagaaaggggttcggctctgttgccgctttgaggcgtggtatctgggcaggttgacgaacttctgtgtccgttttgtggagtaacacaggggacaggttgaagaggagggtctttgtaggcaggtccggctggcacggttaaaggtcgtctctcagggaggtttgggagcgagaggattctccggacagtgaagtcagaccaattggactccgctggccggcataatagagaagcccaacgccggggaactcgctgcgggacaggaccggagggatgatattcgcgacacggaaagaaaggctttttgagagagaggagttgatttaagaagacggcatgccatcccctatctctggctagtctgaggggaactagaaatctctcgatcgtcgtgcgtgccttagagacaggacgatgcttttgaagcggtgagcagctgagcagtagagtaggcaggcgctcggaaccatcaatgaatgaagcgagggctccgggaagggaggagagtatgtttgtaggcagatggagtctgatggagctagaagttctggatttcttggagatagatttgagaggaagagaatacttccagaggtgtccttagggaaggtcaaatctgtcaacaagctttatttagcagttggtgtgtagttctgttcttggtatttcggaggattctgattacatatgacaagtactaaaggacttggttcaccagaggaagtaaaagggtgagttgaatacattgggattattcaggaaagtcatcctggagagtggcattaaggactgggacccttctactcattaattttgtccctctctttctcccatagaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattg

SEQ ID NO: 178395 - DNA, 533 bp, Homo sapiens
  Payload ID: 15126
  Gene Symbol:
  Gene Name: RP11-872D17.8
  ENST ID: ENST00000528835
  CDS Start-End: 1-88
gcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgt

SEQ ID NO: 178396 - DNA, 681 bp, Homo sapiens
  Payload ID: 15126
  Gene Symbol:
  Gene Name: RP11-872D17.8
  ENST ID: ENST00000529411
  CDS Start-End: 1-681
actttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttgg

SEQ ID NO: 178397 - DNA, 576 bp, Homo sapiens
  Payload ID: 15127
  Gene Symbol:
  Gene Name: RP11-87C12.2
  ENST ID: ENST00000546333
  CDS Start-End: 49-306
tccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatggtctgcaagtggatgatgagattgtggagttcggctctgtgaacacccagaacttccagtcactgcataacattggcagtgtggtgcagcacagtgaggggaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagagg

SEQ ID NO: 178398 - DNA, 936 bp, Homo sapiens
  Payload ID: 15128
  Gene Symbol:
  Gene Name: RP11-886H22.1
  ENST ID: ENST00000590532
  CDS Start-End: 1-516
atcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttt

SEQ ID NO: 178399 - DNA, 690 bp, Homo sapiens
  Payload ID: 15129
  Gene Symbol:
  Gene Name: RP11-894J14.5
  ENST ID: ENST00000607283
  CDS Start-End: 1-371
ttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggagaggccaagaaaaccatggaggagcagtggaccttggtgtccctgctgagcacaagccagcaacaaggacctgtccccccaggctccacggcatcctcagccacagacaagctcagccgctgggagtgtgcacctgtcacaagaaggtggacttttaaatattctccactgaagcaaatgctgcaacaatttgcatttccttcaccaatgtcgtcttgtgccttttcttgttcctactgtaaaggagatgggttagatgttaaacgaagtctcactgtgttgtccaggctggtctcaagctcctgggctcaagcaatacttccacctcagcctcccaaaatgctgggattacaggtatgagtatcgat

SEQ ID NO: 178400 - DNA, 768 bp, Homo sapiens
  Payload ID: 15129
  Gene Symbol:
  Gene Name: RP11-894J14.5
  ENST ID: ENST00000607203
  CDS Start-End: 1-77
ttctcctgcttgccatcaatggagtgacagagtgtttcacatttgctgccatgagcaaagaggaggtcgacagatgaattagcagcagttagcccttgttccagcgcagtcgattcttcaccagttgacttttccattcttcttgggaagcgcggcttaaaaagaaagtgctggagaggccaagaaaaccatggaggagcagtggaccttggtgtccctgctgagcacaagccagcaacaaggacctgtccccccaggctccacggcatcctcagccacagacaagctcagccgctgggagtgtgcacctgtcacaatggtgctaaaaaaaatctggattcaaatccagccagcagcgtgactttgagcaagtttgtgaagtgggatatttctcagagcggttgagggaggtggcttgagctcgcacctggcacacggaagactcaagatttacagggcgcctcctgcggaagcctagagacatcgggggcgccgaagggcccgcgccggacttcgcagacagggggcacttgggtgccctttcaggtctcagagggagcgcccgatccccgacgaggggcaggcaaacgggcgcagtgcccgcggcggcggcacgcgcgcatctgggatccggccgcttctccgctcatgccatcttgtccgagccagtcacgtgcgggcgacagcggcgcgcttcgccgggccggtactccaggtccgacccgcgaacccctctgggatccccgccgctctgtctacaacccgagg

SEQ ID NO: 178401 - DNA, 823 bp, Homo sapiens
  Payload ID: 15129
  Gene Symbol:
  Gene Name: RP11-894J14.5
  ENST ID: ENST00000607495
  CDS Start-End: 1-101
ttctcctgcttgccatcaatggagtgacagagtgtttcacatttgctgccatgagcaaagaggaggtcgacaggttattcccagcactttctatgttgtaaactgttaagtgaatatcctgacacagagtcctccaagagcctggtctccttctccattttgcctgctgatgaaccctgagagtgaacttcaccgcctctcagccccagcctcgcccctaagagagcctaggatggaagggagcctgcccaggtcatattgagttgatgaccagccagcctggagcctgagactcaggacctgtagaggccaagaaaaccatggaggagcagtggaccttggtgtccctgctgagcacaagccagcaacaaggacctgtccccccaggctccacggcatcctcagccacagacaagctcagccgctgggagtgtgcacctgtcacaaaaacgaagtctcactgtgttgtccaggctggtctcaagctcctgggctcaagcaatacttccacctcagcctcccaaaatgctgggattacagatggagtcttgctctgtcgcccaggctggagtgcagtgatgcgatctcggctcactgcaacctccacctcccctggttcaagtgattctcctgcctcagcctcccaagtagctgggactacaagcccgtgccaccatgcccagcactttcatttggacccgtggatacccattgaacagatgcttgaaacctgcaagtaatcttcagatcctagcagaaccataggcctttcctttgttttgggaggatatagcctgcctatatgctgtggaaatgaacgggg

SEQ ID NO: 178402 - DNA, 1498 bp, Homo sapiens
  Payload ID: 15130
  Gene Symbol:
  Gene Name: RP11-903H12.5
  ENST ID: ENST00000553909
  CDS Start-End: 191-286
acacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaa

SEQ ID NO: 178403 - DNA, 930 bp, Homo sapiens
  Payload ID: 15131
  Gene Symbol:
  Gene Name: RP11-934B9.3
  ENST ID: ENST00000555591
  CDS Start-End: 1-771
atggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacaggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcaggtgagcacgcaagtagcacaggctgcgctcaggacggctctgccacgtgctagtaggctccttttagggggttgttgagctgtgactccaagtcaaggtgcaacgctgggcgcaggatacccaaccgtgctttcgcagagctggtacaacagtgtgatgcaatgcctgctgttaccagaagagggatccaggccacacggaagggagtcgtg

SEQ ID NO: 178404 - DNA, 694 bp, Homo sapiens
  Payload ID: 15132
  Gene Symbol:
  Gene Name: RP11-96L14.7
  ENST ID: ENST00000407889
  CDS Start-End: 5-196
caccatgcgatttcgacgcttgacccctggttacttccgggtgttacagatgcaggtagctggtgagctgaaggcagagccccggagtctgctggcaggagttgtggctacagtgctagctgtcctcggcctgggtggctcctgctatgccgtctggaagatggtggggcagcggcgggtgccacgggccccgtaacgaagaagagagactctcacttggatgctggggggctcgacgctcagctgcttcagcctgggagaaagaaaaacaggagttgggagctgaccagccctagcttgtccctgacgccaggatccgggtctgagaaacgggaggcgggcggacccacgggtcccaagagagaagactctgcgctgcctggggcttcaacttcacatctcccggccggtaccgcggaccctcctccgccccaggccgggctcgtccgggactcacgcgcaggccagacagcggtgcagaccgccccctggcaggtcggggtcgaactcggcgtttgggtcgggctggggtcgtgcggatccctgaggccgcagctcgcggtgaatctcatccaagtccggccgccgccgcttcgccttcatctgccgggctagagagtgcgctcggtgcgcgcctgtccggcgggagcgacccatggccagaaacagcccggccggccaaggggccaggagc

SEQ ID NO: 178405 - DNA, 579 bp, Homo sapiens
  Payload ID: 15132
  Gene Symbol:
  Gene Name: RP11-96L14.7
  ENST ID: ENST00000433939
  CDS Start-End: 81-272
ggcaggcgcgggtgagcatcctctgagagcttgggtcttgcgtatgtggaaggccgccagggagaccagtgccgcccaccatgcgatttcgacgcttgacccctggttacttccgggtgttacagatgcaggtagctggtgagctgaaggcagagccccggagtctgctggcaggagttgtggctacagtgctagctgtcctcggcctgggtggctcctgctatgccgtctggaagatggtggggcagcggcgggtgccacgggccccgtaacgaagaagagagactctcacttggatgctggggggctcgacgctcagctgcttcagcctgggagaaagaaaaacaggagttgggagctgaccaggtgagagccctatctgctgagcacccatccatcaatcctctccttactccttcataccttttcttgtggtctttggatcggaagtgggtcttcaggttggtggaatcgatgaagtacctcctgtaggaatggaagtgagaaggagagtgaggaggtgatagtctcccaagtgcacctatctccctagccctagcttgtccctgacgccaggat

SEQ ID NO: 178406 - DNA, 1468 bp, Homo sapiens
  Payload ID: 15132
  Gene Symbol:
  Gene Name: RP11-96L14.7
  ENST ID: ENST00000448923
  CDS Start-End: 161-352
ggcaggcgcgggtgagcatcctctgagagcttgggtcttgcgtatgtggaaggtcagagacccctctaccctagtttccacttcttggtgtcatgaagaccactggtcttcacgtccgctcccaccctacaggccgccagggagaccagtgccgcccaccatgcgatttcgacgcttgacccctggttacttccgggtgttacagatgcaggtagctggtgagctgaaggcagagccccggagtctgctggcaggagttgtggctacagtgctagctgtcctcggcctgggtggctcctgctatgccgtctggaagatggtggggcagcggcgggtgccacgggccccgtaacgaagaagagagactctcacttggatgctggggggctcgacgctcagctgcttcagcctgggagaaagaaaaacaggagttgggagctgaccaggtgagagccctatctgctgagcacccatccatcaatcctctccttactccttcataccttttcttgtggtctttggatcggaagtgggtcttcaggttggtggaatcgatgaagtacctcctgtaggaatggaagtgagaaggagagtgaggaggtgatagtctcccaagtgcacctatctccctagccctagcttgtccctgacgccaggatccgggtctgagaaacgggaggcgggcggacccacgggtcccaagagagaagactctgcgctgcctggggcttcaacttcacatctcccggccggtaccgcggaccctcctccgccccaggccgggctcgtccgggactcacgcgcaggccagacagcggtgcagaccgccccctggcaggtcggggtcgaactcggcgtttgggtcgggctggggtcgtgcggatccctgaggccgcagctcgcggtgaatctcatccaagtccggccgccgccgcttcgccttcatctgccgggctagagagtgcgctcggtgcgcgcctgtccggcgggagcgacccatggccagaaacagcccggccggccaaggggccaggagcagggcagggagcacacgtgtgagcacttccgggccgatcagctacgtcaggccacgccggggggctaggcaggctcggccggaccgcctctgatgacgtcactctcggccagcggctcgagcgccgccaggcggccgtcgacgtcagtgaccgagctcaggacgggctcccagaagtgtgcccactgaagggcatggccccgcgggccctcgctggggaggcgcggggtggtgcgtgcgcctgggggtttcggggccgtcttgctgccctgctcttcctggcctggtccaaccagtatcagtgccaacctgtactcctgtcatcccttcctgtttcccagaccttggactccgcggtgggggtgggatgctttatctctggaaagcactgataaatgtctgtgtcatgaataaattagtaaatgactgaga

SEQ ID NO: 178407 - DNA, 466 bp, Homo sapiens
  Payload ID: 15133
  Gene Symbol:
  Gene Name: RP11-96L14.8
  ENST ID: ENST00000635463
  CDS Start-End: 83-439
agttcctagagccagactcactggtatccactgagccaccaccttcctgtgcttgcgtgccaggccccttccccctgcagccatgaaccaggccttctggaaaacctacaagtccaaagtgctacagaccctgagtggggaatctgaagaagacctggcagaggagagggagaacccagcattagtggggtctgagacagcagaaccgaccgaggagaccttcaatcccatgtcacagctggcccgccgggttcagggggtcggggtgaaaggctggctgacaatgtcatctctgtttaacaaagaagatgaagataagctgctgccatcagagccttgcgctgaccagtatgtgcgtgtgtgtttgtggtggttctggaaggggcctgaggtcccccttctgcctggtcctttccttctggtttgtttgtctttctaaccactgagggctggggaggggcagtcc

SEQ ID NO: 178408 - DNA, 643 bp, Homo sapiens
  Payload ID: 15133
  Gene Symbol:
  Gene Name: RP11-96L14.8
  ENST ID: ENST00000634842
  CDS Start-End: 83-643
agttcctagagccagactcactggtatccactgagccaccaccttcctgtgcttgcgtgccaggccccttccccctgcagccatgaaccaggccttctggaaaacctacaagtccaaagtgctacagaccctgagtggggaatctgaagaagacctggcagaggagagggagaacccagcattagtggggtctgagacagcagaaccgaccgaggagaccttcaatcccatgtcacagctggcccgccgggttcagggggtcggggtgaaaggctggctgacaatgtcatctctgtttaacaaagaagatgaagataagctgctgccatcagagccttgcgctgaccaccctctggcggcgcgacccccctcgcaggcggcggcggcggcggaggcgcgcggcccgggcttctgggacgcgttcgccagcaggtggcagcagcagcaggccgcggcggcgtccatgctgcgcggcaccgagcccactccggagccggaccccgaacccgcggacgaggccgcggaggaggccgcagagcgccccgagtcgcaggaggccgagccggtggccggcttcaagtggggcttcctcactcacaaactggccgagatgagggtgaaggctgcgcccaagggtgactag

SEQ ID NO: 178409 - DNA, 1060 bp, Homo sapiens
  Payload ID: 15134
  Gene Symbol:
  Gene Name: RP11-96O20.4
  ENST ID: ENST00000564080
  CDS Start-End: 193-1060
ttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcagtga

SEQ ID NO: 178410 - DNA, 566 bp, Homo sapiens
  Payload ID: 15135
  Gene Symbol:
  Gene Name: RP11-977G19.10
  ENST ID: ENST00000547423
  CDS Start-End: 250-566
accgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggagaatgcatcttgtcttgttcttgcagcccggcatgccagtgcttcctccacgaatttgaaagacatattggctgacctgatacctaaggagcaggccagaattaagactttcag

SEQ ID NO: 178411 - DNA, 937 bp, Homo sapiens
  Payload ID: 15135
  Gene Symbol:
  Gene Name: RP11-977G19.10
  ENST ID: ENST00000549318
  CDS Start-End: 149-937
ctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatggagggaccagcaagaacagagacaggaaggggaaaatggatgtgaccaactcagctgaaaaatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatg

SEQ ID NO: 178412 - DNA, 512 bp, Homo sapiens
  Payload ID: 15135
  Gene Symbol:
  Gene Name: RP11-977G19.10
  ENST ID: ENST00000548360
  CDS Start-End: 265-512
ctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggagatcccggagatcgcccgccatggctttacttactgcggccgccc

SEQ ID NO: 178413 - DNA, 1126 bp, Homo sapiens
  Payload ID: 15136
  Gene Symbol:
  Gene Name: RP11-983G14.2
  ENST ID: ENST00000621301
  CDS Start-End: 92-1042
tgtggcataccttgtgtttagttcaagaactataatctagatgtaacacctgaaaataaactcttttattgatattctacaggcagaagaaatgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttctttctgggcaacttggccttcctggatgcatcctactccttcattgtggctcccaggatgttggtggacttcttctctgagaagaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccatgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtacca

SEQ ID NO: 178414 - DNA, 789 bp, Homo sapiens
  Payload ID: 15136
  Gene Symbol:
  Gene Name: RP11-983G14.2
  ENST ID: ENST00000631033
  CDS Start-End: 1-634
cctccttggtctgactcagtctcaagatattcagctcttggtctttgtgctgatcttaattttctaccttatcatcctccctggaaattttctcattattttcaccataaggtcagaccctgggctcacagcccccctctatttctttctgggcaacttggccttcctggatgcatcctactccttcattgtggctcccaggatgttggtggacttcttctctgagaagaaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccatgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtaccattgtaggcaatggaggagagttatgcataatgagagaataaacttattatatttaaagaatataaaggaaa

SEQ ID NO: 178415 - DNA, 3447 bp, Homo sapiens
  Payload ID: 15137
  Gene Symbol:
  Gene Name: RP1-27O5.3
  ENST ID: ENST00000480336
  CDS Start-End: 91-1629
gtgtcggtgcgcggtgctccgtggctgcgctgctggaacccgctggaagagatacaggtttgctctggagcagcagcagctggcggagcaatggagatgcaatcctattatgccaagcttttgggggagctgaatgaacagagaaagagggactttttctgtgactgcagcatcattgtggaagggcggatcttcaaggcccacaggaacattttgtttgctaacagcggctacttccgagccctgctcattcactatatccaggacagcgggcggcatagcaccgcctccttggacattgtcacctctgatgccttctccatcatcttagatttcctctattctgggaagttggatttgtgtggggagaatgtgattgaagtgatgtcggctgccagctacctgcagatgaatgacgtggtgaacttctgcaagacatacattaggtcatccctcgacatttgccgaaagatggagaaggaggctgctgtggctgcagcagtggcggcggcagcggcggcggctgcagcggcggcagcagcggcggctcatcaggttgacagtgaaagccccagttcaggccgggaggggacctcctgtggtaccaagagcttggtctcctctccagccgagggagaaaagagcgtggagtgcctgagagagtccccttgcggtgactgcggagactgccaccccttggaactggtggtgagagacagccttggcggtggctcggctgacagcaacctctctactccacccaaacggatagagcccaaggtggaatttgatgctgatgaagtggaggtggacgttggtgaacagctgcagcagtatgctgccccgctgaacctggcccacgtggaggaggccttgccaagcggccaggcggttgacttggcttacagcaactaccacgtgaagcagttcctggaggcgctcttgcgcaacagcgctgccccgagcaaggatgatgcagaccatcacttttctaggagtttggaaggaagaccagaaggtgcaggagtagccatgagttccatgatggatgtccaggctgactggtatggagaggactcaggtgatgtgctggtggtccccatcaagctccacaagtgtcctttctgcccttacactgccaaacagaagggcatcctcaagcggcacatccgttcacacacaggcgagcggccctacccctgtgagacctgcggcaagaggttcactcgacaagagcacctgcggagccacgcactgagtgtccacagatccaaccgtccaatcatctgcaagggctgcaggagaacattcacgagtcacctgtcccaggggctgcggcgcttcgggctgtgtgacagctgcacctgcgttacagacacacccgatgatgatgatgatttgatgcccatcaaccttagcttggtggaggcttcatctgaaagccaagaaaagagcgacacagacaatgactggccaatctatgtggagtcggagatcgggtctcattatgttgcccaggctagtctggaactcctggccttaagccaacctcctgcctcagcctcccaaagtgctggcattacagacggagtctcactctgttgcccaggccggagtacagtggcatgatctcagctctctgcaacctccacctcctgggttcaagacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaacttta

SEQ ID NO: 178416 - DNA, 679 bp, Homo sapiens
  Payload ID: 15138
  Gene Symbol:
  Gene Name: RP1-309K20.6
  ENST ID: ENST00000454607
  CDS Start-End: 1-421
aggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctg

SEQ ID NO: 178417 - DNA, 611 bp, Homo sapiens
  Payload ID: 15138
  Gene Symbol:
  Gene Name: RP1-309K20.6
  ENST ID: ENST00000441563
  CDS Start-End: 1-175
aggggaaagtctgctgatggcactgaaggacgttgccttatcctcagggagcgcactcttctatcaggtttggaattggccgcttcactacagaggaggaagtggactacacagtggagaaatgcattcagcatgtgaagcgtcttcgagaaatgagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctg

SEQ ID NO: 178418 - DNA, 872 bp, Homo sapiens
  Payload ID: 15138
  Gene Symbol:
  Gene Name: RP1-309K20.6
  ENST ID: ENST00000541176
  CDS Start-End: 1-485
tgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctg

SEQ ID NO: 178419 - DNA, 1922 bp, Homo sapiens
  Payload ID: 15139
  Gene Symbol:
  Gene Name: RP13-1032I1.10
  ENST ID: ENST00000571730
  CDS Start-End: 132-1460
tttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggccctggaggcgacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctga

SEQ ID NO: 178420 - DNA, 334 bp, Homo sapiens
  Payload ID: 15140
  Gene Symbol:
  Gene Name: RP1-317E23.6
  ENST ID: ENST00000527604
  CDS Start-End: 1-132
aaggagctggaggaactgcagaacaaccaggagaactcgtcccaccagaagctggctggcctgcacctggagaagtacagcttccccgtggagatgatgatctgcctgcccaatggcaccgtgatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctt

SEQ ID NO: 178421 - DNA, 291 bp, Homo sapiens
  Payload ID: 15141
  Gene Symbol:
  Gene Name: RP1-321E8.5
  ENST ID: ENST00000613352
  CDS Start-End: 1-125
aagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 178422 - DNA, 4369 bp, Homo sapiens
  Payload ID: 15142
  Gene Symbol:
  Gene Name: RP13-279N23.2
  ENST ID: ENST00000494072
  CDS Start-End: 1-889
gtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggaccccctgtcggaggtagaggggctggggtctggtggtggggccgctgctgacctctctgcctctgtcccctgcccttgtgttccagcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagacatcagctgaagcgcttctgggtcctaagcccttttggggacccagagatgtcctcaagggacaaggcctaggagctgggatggatgatcacagattattaggcgagacagattggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctgtgaggcaggactacctcctgagaccatcacttcccagccatggggcccagggcaaagaccatctcctccctgttcttcctcctatgggtcctggctgagccggctgagaactcggacttctacctgcctggggattacctcctgggtggcctcttctccctccatgccaacatgaagggcattgttcaccttaacttcctgcaggtgcccatgtgcaaggagtgatgttggtgatgatggtgatggtagtgatgatggtgttggtggtgatgatagtgatgctgaagatggtgctgatggtggtgatggtgttggtgatgatggcgatggtagtgatgctggtgatggtgttagtgatggtgttggtgatggtggtgatcgtagtgatgctgatgatggtgataggctacaacctcatgcaggccatgcgctttgcggtggaggagatcaacaatgacagcagcctgctgcctggtgtgctgctgggctatgagatcgtggatgtgtgctacatctccaacaatgtccagccggtgctctacttcctggcacacgaggacaacctccttcccatccaagaggactacagtaactacatttcccgtgtggtggctgtcattggccctgacaactccgagtctgtcatgactgtggccaacttcctctccctatttctccttccacagatcacctacagcgccatcagcgatgagctgcgagacaaggtgcgcttcccggctttgctgcgtaccacacccagcgccgaccaccacatcgaggccatggtgcagctgatgctgcacttccgctggaactggatcattgtgctggtgagcagcgacacctatggccgcgacaatggccagctgcttggcgagcgcgtggcccggcgcgacatctgcatcgccttccaggagacgctgcccacactgcagcccaaccagaacatgacgtcagaggagcgccagcgcctggtgaccattgtggacaagctgcagcagagcacagcgcgcgtcgtggtcgtgttctcgcccgacctgaccctgtaccacttcttcaatgaggtgctgcgccagaacttcactggcgccgtgtggatcgcctccgagtcctgggccatcgacccggtcctgcacaacctcacggagctgcgccacttgggcaccttcctgggcatcaccatccagagcgtgcccatcccgggcttcagtgagttccgcgagtggggcccacaggctgggccgccacccctcagcaggaccagccagagctatacctgcaaccaggagtgcgacaactgcctgaacgccaccttgtccttcaacaccattctcaggctctctggggagcgtgtcgtctacagcgtgtactctgcggtctatgctgtggcccatgccctgcacagcctcctcggctgtgacaaaagcacctgcaccaagagggtggtctacccctggcagctgcttgaggagatctggaaggtcaacttcactctcctggaccaccaaatcttcttcgacccgcaaggggacgtggctctgcacttggagattgtccagtggcaatgggaccggagccagaatcccttccagagcgtcgcctcctactaccccctgcagcgacagctgaagaacatccaagacatctcctggcacaccatcaacaacacggtcagccagggggcctggtgggtgggcaggcctggggcggggcctggggcccttgctggagtggctag

SEQ ID NO: 178423 - DNA, 1147 bp, Homo sapiens
  Payload ID: 15143
  Gene Symbol:
  Gene Name: RP13-347D8.7
  ENST ID: ENST00000620151
  CDS Start-End: 1-975
atgtctgccacaggggatcaagacctgatccaagaggaccaggaggctccagtgaaccaggagggagcgcaggccgaggccgtaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcgtggcggccgcctgatgcggaggcgccgcactgcggcgcccagtggctcagaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccgcagaggaggcctcagagaagcccacagaggaggccgcagaagagcccgcagaggaggcctcagagaagcccacagaggaggccgcagaggaggagctcgcagaggaggccgcagaggaaccggccaaagaggaaccggctgcagaggaggagtccgcagaggaaccggccacagaggaggctgctgcccctgaggaagtcactaaatatcagcatgaaaagtgggatgaagaggcccaagatgctgcaggcaaggaagagaaagaagagaaagagaaggatgctgaaaacaaggtgaagaactccaaagggacctagacgcagcagaggggaagctgagaaaatccagatgcctgtgagaattttaacacatatcattccaaagttcattaccttaaaagtgatatctagtgacatctaacttttatctttcacaaatgtatttgacagtgtttgttcaagttagaaataaaagtttgttttaaatgaa

SEQ ID NO: 178424 - DNA, 948 bp, Homo sapiens
  Payload ID: 15144
  Gene Symbol:
  Gene Name: RP1-34B20.21
  ENST ID: ENST00000635200
  CDS Start-End: 51-560
acttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaaggggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgtt

SEQ ID NO: 178425 - DNA, 1637 bp, Homo sapiens
  Payload ID: 15144
  Gene Symbol:
  Gene Name: RP1-34B20.21
  ENST ID: ENST00000635641
  CDS Start-End: 51-563
acttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaaggcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgttgctgtccgtaaactggaacctctgttcactcaagggacgaggtctcactgtgttacccaggctggcctcaaaactccttagcttggccaggcgaggtggctcaggcctgtaatcacagcactttaggatgccaaggcgggcggatcacgtgatgccaagagttcgagaccagcctgcccaacacattgaaacttcgtctctactgagaatacaaaaattagccgggtgtggtggcacacgcctgcagtcccagctacatggaaagctgaggcaggagaagggcttgaacccgggaggcggaagttgcagtgaaccgagatcacaccactgcactccagcctgggcagcagagctagactccttcaaaaaaaaaaaaaaaatccccaaggacaaacaaaaccaccaaaaacaactccttagcttaagagattctcccgccttggcctcacaaaatgctgagattacaaacgtaggccaccgcgaccggcaagggccgatcttcatatcgtagccgccaacacctacttgagcgcggccacagagaaggccgctgcgcttcttggagacggctaagtcattagtgatgaactcacataccggaggggcctggacatcttgcacttcactgcaacttcggacttgcaacctttttctttacttcagtctttgacttgggagatagacca

SEQ ID NO: 178426 - DNA, 421 bp, Homo sapiens
  Payload ID: 15145
  Gene Symbol:
  Gene Name: RP13-512J5.1
  ENST ID: ENST00000438485
  CDS Start-End: 1-105
cttacccaggggatggacattcagtggatgcatgttcctggtcattcgggatttataggcaatgaagaagctgacagattagccagagaaggagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacaccta

SEQ ID NO: 178427 - DNA, 2897 bp, Homo sapiens
  Payload ID: 15146
  Gene Symbol:
  Gene Name: RP13-582O9.6
  ENST ID: ENST00000522452
  CDS Start-End: 792-1391
gggaggtcctcgtcgcctctcgtctccagccaggtactcactgggctcctgcctgccgcctccggcccaggacgcgcagcgtcggtatgggccccgccgcctccccgcaccccggcgctccagggatgtggcaagacccggctttgagcacctcccgggcgccggccccgaggccgacctagctctgcacgtgggccgcggggctctgccgttgaaaggagagcctctaactaggagcacgcacgggaccctggcgggcccctccgcctggctcagatgcctggcatctcaggccttggcacagctagcaggcccctggcaggccgtggacccagcaggctgttttagtgcagattgcccctgaatctcaagcccactaatgttccagtctctccatgagacccagatccctgaaagtagtggagggaggcgccagggtgagtgaggttttctaggcagcccttaccgcccacggatacccagagcttcatattacaagtgaagggtcctccgcccagagaggcgacggagctacgctggagttgcacgacagaaccagaaccccagtctttaggggtgtggcaagcgtgggttgcgctgtttgtaactagctaatcactcctgtctacaggcctgtgagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcaggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagt

SEQ ID NO: 178428 - DNA, 567 bp, Homo sapiens
  Payload ID: 15147
  Gene Symbol:
  Gene Name: RP13-672B3.2
  ENST ID: ENST00000537262
  CDS Start-End: 204-567
aggttccacccaaggacccaacaggggccccgcgcgcccggggaagccacggcaaggggagcgggtccgcaggcgcgggtgaagacagggcgaggggagcggtggcattttgtcagcacttgggaacttcctggcccagatgattgagaagaagcggaaaaaagaaaactctagaagtctggatgtcggtgggcctctgagatatgccgtttacgggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggcgagaaccactgtctctgatcaacgtgcggaagaggaacgtggaatctggggaa

SEQ ID NO: 178429 - DNA, 4904 bp, Homo sapiens
  Payload ID: 15148
  Gene Symbol:
  Gene Name: RP1-37E16.12
  ENST ID: ENST00000455236
  CDS Start-End: 1-621
aagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtctgatgatggaggagccttggccctggctgtcccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacactttgaggccaacatacttacccagaaccgctgtcaaaactgcttccaccctgaggaggcccatggagcaagataccaggagctcaggagcccttcaggtgctgaggtgccctactgcgacctgcctcgatgtccacctgcccctgaggacccactcagcgcctcaacctccggctgccagtctgtggtggacccaggcctcaggccagggcccaagaggggcccatccccctcagcagggctcccagaagagggtcccacagctgcccccaggagcaggagccgggagcttgaggcagtaccctatctggagggcctgaccacttccttgtgtggcagctgcaacgaggaccccggctctgaccccacctccagccctgactccgccacccctgatgataccagcaactcgtcctctgtggactgggacactgttgagaggcaggaggaggaggcccccagctgggacgagctcgcagtgatgatcccgaggaggcctcgggaggggccgagagctgacagctcccaaagggctccgtctctcctcaccaggtcccctgtgggaggagatgctgcaggccagaaaaaggaggacaccggcggtgggggccggagcgcaggacagcactgggcaaggctccggggagaaagcgggttgtccctggagcggcaccggtcaacactgacccaggcttcctccatgacaccacacagtggacctcgaagcaccacgtctcaggcttctcctgcccaaagggacactgctcaggctgcctctacacgtgaaatccccagagcctcctctccccatcgaatcacccaaagggacacctccagggcctcatccacccaacaggaaatctccagggcctcatccacccaacaggaaacctccagggcctcatccacccaagaggacacccctagggcctcatccacccaagaggacacccccagggcctcatctacacagtggaacacccccagagcttcctctccctcacgaagcacccaactggataaccccagaacctcttctacccagcaggacaacccccaaacttcttttcctacttgtactccccagcgggaaaaccccaggacaccctgtgtccagcaggacgatcccagagcctcctctcccaacagaaccactcaacgagagaattccagaacatcctgtgcccagcgggacaatcccaaagcctccagaacctcctctcccaatagagccacacgagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgcgcccagcgggacaatcccagagcctcctctcccaatagagctgcacgagacaaccccacaacatcctgtgcccagcgggacaatcccagagcctccagaacctcctctcccaatagagccacacgagacaaccccagaacatcctgtgcccagcgggacaatcccagagcctcctctcccaatagagctacacgagacaaccccacaacatcctgtgcccagcgggacaatcccagagcctccagaacctcctctcccaatagagccacacgagataaccccagaacatcctgtgcccagcgggacaatcccagagcctcctctcccaacagaaccacccaacaagacagccccagaacatcctgtgcccgacgggacgatcccagagcctcctctcctaacagaaccatccaacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcag

SEQ ID NO: 178430 - DNA, 489 bp, Homo sapiens
  Payload ID: 15149
  Gene Symbol:
  Gene Name: RP1-4G17.5
  ENST ID: ENST00000577138
  CDS Start-End: 47-298
gtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttg

SEQ ID NO: 178431 - DNA, 582 bp, Homo sapiens
  Payload ID: 15150
  Gene Symbol:
  Gene Name: RP1-66C13.4
  ENST ID: ENST00000582441
  CDS Start-End: 68-547
gcactcgtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaaaattcacctgctgcatccatcatcagaagaggccaggaatgcggcctgctgggtgggcagggccaagaagaaggcagccgtgcaggcccaggaagccgtaggagacttgccaacctccaggagggggccagccctggaccctgcagacaggcgctctggggagggtaccagaagctcactgtttgtcccggcttgaaggctgtttgctgtgtgaccttgccccacagtgaagaacatctgagctcaaatccagataagtgacataagtgacctgctttgtaaagccatagagatgg

SEQ ID NO: 178432 - DNA, 654 bp, Homo sapiens
  Payload ID: 15151
  Gene Symbol:
  Gene Name: RP3-369A17.6
  ENST ID: ENST00000562221
  CDS Start-End: 1-183
agcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggaggaccacctgctgggaactttgcagctgagtacatggaagaagtggctcacttgttgcaagatgaggagttggcaccaaaaataaagatcctgctgctccagagtgtggcatgttggtgttacttaaaccctgtcagccagaaaagagccaaaagtctgcaatttattcctattctcattagtttttttgaaggcagattcgagtctactatcaaaagtgaaacaaacagctacctcctccttaaattttggacttgttacgttctctctgtcatgacatgcaataacttgtcttgcgtcaaggagcttaaagaccacagtgctctaaaatatcatttgcaaatgttggctgctgagaattggtctggatggacagagaattttgcagaggtgctgtatttcctaattggttttcataggaattagtttctctaaatccagttacatgttgcagctctctgtg

SEQ ID NO: 178433 - DNA, 958 bp, Homo sapiens
  Payload ID: 15152
  Gene Symbol:
  Gene Name: RP3-461F17.3
  ENST ID: ENST00000261406
  CDS Start-End: 1-654
ggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaagagatgcgacttgctctgttgtccagacttgagtgcagtagctcaatcatagctcactgcagccttgaattccgggctaccacacccagcttgttactgtatttttgaatgtctgaagtgaagaatgaatctaagtggggactgcttggctcggtcattcagttacatccacagcacagagaaactgaggattctttgttgatgaggtgtctggatcgtatctattccagagtaaagtcatgatggctttatgacgttctgaggtgcgttttgcaggaggggacgttgttgagttccaaacaggtgaggtattgcacactagcaaacacatgagaagaaggcggaggaattgggag

SEQ ID NO: 178434 - DNA, 1087 bp, Homo sapiens
  Payload ID: 15152
  Gene Symbol:
  Gene Name: RP3-461F17.3
  ENST ID: ENST00000607161
  CDS Start-End: 1-672
aagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtgtctggatcgtatctattccagagtaaagtcatgatggctttatgacgttctgaggtgcgttttgcaggaggggacgttgttgagttccaaacaggtgaggtattgcacactagcaaacacatgagaagaaggcggaggaattgggagaaaaataaaaagaatgcagcaggccaggttagcaggaacgttaagacggtgacggagaacagcaaagcctggaagcaagccgccgtggagaaggaagaactgtgctgagtacttcactctgttgcccaggctggagtgcagcggcacaatcacagctcactgcagtttcaacttcctgggttcaagtgatcctcctgcctgagcctcccaagtagctaggactataggtatgtgccgccatgcccccaaaacaacagcaaattatgtgtgtgtgtgtgtgtgtgtgtgtgtgtgtgtgtgtgtgtgtgtgtgt

SEQ ID NO: 178435 - DNA, 762 bp, Homo sapiens
  Payload ID: 15153
  Gene Symbol:
  Gene Name: RP3-468K18.5
  ENST ID: ENST00000545614
  CDS Start-End: 1-58
cacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggacaaggtcaaagatgtaaggggaaacttgaaagcaacgtgcttgctggtatcctagacagaagaccggaggattggaaccaaaaaattaaaaacaaacagattctcatgaagtgaacctgatttgaagcaaagctcgtgccccctgacgcatcctagatactgaaggtcctgtttcaggaaacgatcgtcctgaagtacaatgcagtgaggtgaataactacattcagctgagaaaacgacagtagctcacgttcatcaaatgcttactagaagccaagcacaggtccaagtacttcatacccatcctctcatttaatccaacaacaactctggaagcctcacaggaagaaaaagccctttatagagaagaagaaagctgtgtcttttcacttggtccaccggagccaacgagatcctttagcagcagatgagagtgcaccccagagggttctattgcccacacaaaaa

SEQ ID NO: 178436 - DNA, 1496 bp, Homo sapiens
  Payload ID: 15154
  Gene Symbol:
  Gene Name: RP3-468K18.7
  ENST ID: ENST00000454207
  CDS Start-End: 117-539
ttgatcctgacattgttgcagctcttgatgatgattttgactttgatgatccagataatctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaaatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacctgtataatgcatgattcaaattcacttgaagtttaattggacatttgatgggtttttaaagacaatgttgctttgatattagaacctttttagtagactagtaattggaatactaacattatttacttacta

SEQ ID NO: 178437 - DNA, 694 bp, Homo sapiens
  Payload ID: 15155
  Gene Symbol:
  Gene Name: RP4-539M6.19
  ENST ID: ENST00000439023
  CDS Start-End: 1-434
ctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtacca

SEQ ID NO: 178438 - DNA, 1470 bp, Homo sapiens
  Payload ID: 15155
  Gene Symbol:
  Gene Name: RP4-539M6.19
  ENST ID: ENST00000439838
  CDS Start-End: 1-1017
gctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagta

SEQ ID NO: 178439 - DNA, 872 bp, Homo sapiens
  Payload ID: 15155
  Gene Symbol:
  Gene Name: RP4-539M6.19
  ENST ID: ENST00000454552
  CDS Start-End: 1-223
gaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtacca

SEQ ID NO: 178440 - DNA, 1625 bp, Homo sapiens
  Payload ID: 15156
  Gene Symbol:
  Gene Name: RP4-559A3.7
  ENST ID: ENST00000432920
  CDS Start-End: 169-1248
atccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaaggcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgact

SEQ ID NO: 178441 - DNA, 568 bp, Homo sapiens
  Payload ID: 15157
  Gene Symbol:
  Gene Name: RP4-576H24.4
  ENST ID: ENST00000567028
  CDS Start-End: 38-568
agacgtttgaacagagcaggctcctgaggtctccaggatgcctgtcccagcctcctggccccaccctccttgtcctttcctgctgctgactctattgctgggactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcggagtcacacatgtgttccatgtgcaacaaacggagatgtcacagactgtatcaactggggagtcaatcatcttgagttgcagcgtacccaataccttacca

SEQ ID NO: 178442 - DNA, 563 bp, Homo sapiens
  Payload ID: 15157
  Gene Symbol:
  Gene Name: RP4-576H24.4
  ENST ID: ENST00000566961
  CDS Start-End: 1-422
aattaatctacaatcagaaagaaggccacttcccacgggtaacaactgtttcagacctcacaaagagaaacaacatggacttttccatccgcatcagtaacatcaccccagcagatgccggcacctactactgtgtgaagttccggaaagggagccccgaccacgtggagtttaagtctggagcaggcaccgagctgtctgtgcgtgaggcaagaactgtcttctctgctcggagcactgagtcgagggcatctccaggacaggcattcaggcagagcaagctccaggtttcaccacaatgcccatccctgcctccccactccacccacctctgccttccttactgctgtatctgctgcttgaactggcagtctcttacagttctagaagccagaagtctgaaatctgcatctctggactgaaatcaaggcatcagcagaactgctccttctggaggttctaggagagaacatattccctttctcttttggcttctggtttgctgccagcatccctggcctgtcagcagcatagaataaatcttcaaggccagtgtctttaaa

SEQ ID NO: 178443 - DNA, 588 bp, Homo sapiens
  Payload ID: 15157
  Gene Symbol:
  Gene Name: RP4-576H24.4
  ENST ID: ENST00000564763
  CDS Start-End: 66-584
agagcagagtctgcgatcttcccagcacagacgtttggacagagcaggctcctaaggtctccagaatgcccgtgccagcctcctggccccaccttcctagtcctttcctgctgatgacgctactgctggggagactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgcttttttccaggagtcacacatgtgttccatgtgcaacaaacggagatgtcacagactgtatcaactggggagtcaatcatcttgagttg

SEQ ID NO: 178444 - DNA, 252 bp, Homo sapiens
  Payload ID: 15158
  Gene Symbol:
  Gene Name: RP4-583P15.14
  ENST ID: ENST00000467211
  CDS Start-End: 1-252
ccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcagggctcttccgtgggcggcggct

SEQ ID NO: 178445 - DNA, 3119 bp, Homo sapiens
  Payload ID: 15159
  Gene Symbol:
  Gene Name: RP4-583P15.15
  ENST ID: ENST00000490623
  CDS Start-End: 1-1253
cggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcg

SEQ ID NO: 178446 - DNA, 507 bp, Homo sapiens
  Payload ID: 15159
  Gene Symbol:
  Gene Name: RP4-583P15.15
  ENST ID: ENST00000496820
  CDS Start-End: 1-507
gcgggccctgagcctgcggctcttccagactgaggagaagatcgagcgaacccagcgggacatcaggagcatccaggaggctctcgcccgcaacgctggccggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggac

SEQ ID NO: 178447 - DNA, 872 bp, Homo sapiens
  Payload ID: 15159
  Gene Symbol:
  Gene Name: RP4-583P15.15
  ENST ID: ENST00000632538
  CDS Start-End: 1-871
gttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgag

SEQ ID NO: 178448 - DNA, 602 bp, Homo sapiens
  Payload ID: 15160
  Gene Symbol:
  Gene Name: RP4-613B23.5
  ENST ID: ENST00000431549
  CDS Start-End: 106-357
gtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttgggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagc

SEQ ID NO: 178449 - DNA, 529 bp, Homo sapiens
  Payload ID: 15161
  Gene Symbol:
  Gene Name: RP4-614O4.11
  ENST ID: ENST00000444717
  CDS Start-End: 1-333
ggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgaccccacctcagagttcactccccgagagcccaacctgcaacacgtcaagcagactgccaccctgtcagtccatggctgatggaggacagatgacaagatatac

SEQ ID NO: 178450 - DNA, 554 bp, Homo sapiens
  Payload ID: 15162
  Gene Symbol:
  Gene Name: RP4-635E18.9
  ENST ID: ENST00000612542
  CDS Start-End: 1-184
agaggacttgatcattaaaggaatcagcgttcatatatccaatgccgaacctaagcacaatagcaatagacagttagaaagaagtggaagatttggtggtaatccagcacttgcactattactcagcagcagtaacatggtaacacttaaaatggtactcggggacctccaaagactaaactgacaagccttcaaggagcccaggggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaata

SEQ ID NO: 178451 - DNA, 645 bp, Homo sapiens
  Payload ID: 15162
  Gene Symbol:
  Gene Name: RP4-635E18.9
  ENST ID: ENST00000622108
  CDS Start-End: 1-51
ctcatttcaaatgtttatggaagaagcacttcattgaaagtagtgctgtaaatattctgccataggaatactgtctacatgctttctcattcaagaattcgtcatcacgcatcacaggccgcgtctttgacgcacttgcactattactcagcagcagtaacatggtaacacttaaaatggtactcggggacctccaaagactaaactgacaagccttcaaggagcccaggggctagagtataatggtgcgatctgggctcaccgcaacctccaccacctgggttcaagcaattctgcctcagccgctcgagtagctgggattacaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgt

SEQ ID NO: 178452 - DNA, 700 bp, Homo sapiens
  Payload ID: 15162
  Gene Symbol:
  Gene Name: RP4-635E18.9
  ENST ID: ENST00000611136
  CDS Start-End: 1-268
gcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtgttcatctcatttcaaatgtttatggaagaagcacttcattgaaagtagtgctgtaaatattctgccataggaatactgtctacatgctttctcattcaagaattcgtcatcacgcatcacaggccgcgtctttgacgcacttgcactattactcagcagcagtaacatggtaacacttaaaatggtactcggggacctccaaagactaaactgacaagccttcaaggagcccaggggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaa

SEQ ID NO: 178453 - DNA, 1793 bp, Homo sapiens
  Payload ID: 15162
  Gene Symbol:
  Gene Name: RP4-635E18.9
  ENST ID: ENST00000614757
  CDS Start-End: 95-991
ggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatgcacttgcactattactcagcagcagtaacatggtaacacttaaaatggtactcggggacctccaaagactaaactgacaagccttcaaggagcccaggggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaataca

SEQ ID NO: 178454 - DNA, 823 bp, Homo sapiens
  Payload ID: 15163
  Gene Symbol:
  Gene Name: RP4-734P14.4
  ENST ID: ENST00000461548
  CDS Start-End: 264-605
gccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaaga

SEQ ID NO: 178455 - DNA, 687 bp, Homo sapiens
  Payload ID: 15164
  Gene Symbol:
  Gene Name: RP4-777O23.3
  ENST ID: ENST00000598361
  CDS Start-End: 361-672
cacgctggtgtctgtcctccttacagaatgcctgaacagttccattgactcaaagtgaagatcaaaagaaccaaatgacagcaatagccaagtgtaatcatcagtaaccctgtgttctatccacagttaaaagaatattggcagagaaacagccttggtgttccagcaggagtgaagaggaacaggaaaacgagtggcagtagccctgaaacagccacttctggtggttgccactcacctgaggatgattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatat

SEQ ID NO: 178456 - DNA, 3695 bp, Homo sapiens
  Payload ID: 15165
  Gene Symbol:
  Gene Name: RP5-1021I20.4
  ENST ID: ENST00000556551
  CDS Start-End: 194-1057
actgtggctcccgaagctgcttcgggccccagcggtgaggaagaagactctcaaccagggtgacttctaggcgtcctcccggagctaccggggacactggcgttattgcccgcaacactgagatagggaatgctcgagaaacagaagagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaatgactgttatcttaaagatggaagataacaagtgttggtaaggatatggagaaaagggaacctttgtacactgttggtgggaatgtaagttagtacagccattatggaaaccgtatggaagttcctcagaaaactaaaaatggagccactatatgacccagcaatctcacttgtagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgttatggaagaacttaacttttagaacatttaaacagaacataaccaggttttacagaggagatataaagcaatttctccataccttcaaaagccatatcttctggagaaaagaaagggctctctaggaaacacttgctcctctctggtatagaaatttcacccaagttacacaggccaggccctcttctctgaaaaacttaacagaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 178457 - DNA, 323 bp, Homo sapiens
  Payload ID: 15166
  Gene Symbol:
  Gene Name: RP5-1042K10.14
  ENST ID: ENST00000498234
  CDS Start-End: 1-173
ctttcactggtcgtgcctcccagcaggtgcagagattcttagaagaggaggtgtatcccctgttaaaaccatatgaaagcgtgatgaaggtggtaacacggttcaaaatgaaaaaggtacagaacgagtatgaagtaaaagtctccctgccacctagttcccccaacatgtagcctttattttatatgaaaatttctcccctttttaacaagtattttcacattcttctcactctcctttttttacttagcccctgtcagtgacagctgcacaccattttattctatagatatactgtaattaaacagtcctgtatcagtggg

SEQ ID NO: 178458 - DNA, 546 bp, Homo sapiens
  Payload ID: 15166
  Gene Symbol:
  Gene Name: RP5-1042K10.14
  ENST ID: ENST00000623869
  CDS Start-End: 1-171
atagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggat

SEQ ID NO: 178459 - DNA, 2013 bp, Homo sapiens
  Payload ID: 15167
  Gene Symbol:
  Gene Name: RP5-1052I5.2
  ENST ID: ENST00000370548
  CDS Start-End: 74-985
tgtggggagggtacctctcacagaagagtcttatgactggcatcaggggaaggtcaccaagtctttcctgtacatgctgtttatcaaattcattcatctcgaagtattcagtatgccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacagcaccagatactgctacaccatctcatcggcatggacctatatgtggcagcaagtccatctcatcgcttttggtgaaagtcagtccagtttgtaaagattctcattgccttggaaagtgttccaggaatggactttctgcagtatgatgacctgcaaaagcagcccttccatttacatttcaaactccaagtcagccgtgtcaaagtttgaaccagaactgtggaggataatgggtcagatgcaattagcagcccagagaaccacacgttgcagtctgatttatttttttgcccatcagattccaagaatcctagtgcttaaaagcaactaaacaatcgctctattgtactgaaataaagcccggttaattcagaaatcaattgcaccaccaggtggggcacactctggccccaaacagatggggttgaaaactcccctcaaaatgcagtcttgttaaattaaaaacttgatccaggagtggaacaaatagggagccatgaatggaatggagtcaggtccactcaggcggattctttcttctcccactccttttcctttaaaaaagaaaaattccccatttcactttcatcagtgttagcatctatgcagaaacgcagccatccaccctttgcagttgaatgtgttactttaattagtctgaaaattaaagggcaactccgggccaatgtgaatgattatgaaaatacatgtgcatcccatgcaatcttctcatttaattaatagtcttgtaaactatatggctcactttaagtcagtcaagaggtataacaactccattttaaatatccacttaatacttaacaggatgtgaggaacacactatagcatacggtcccttctcaagtttcactgtctgaaatttttcaaagctgacccaagtcaacctgaaaaatgtttaacaccctgggcttgaacacaagaaactctgtgatgaacagacattcaattacattttttaaaagtgagaagcatttttgtaaaatagcgactctggaaactaattggcagccgcaaaacttgtgagcaaaggccaaatcttgtggggaacttttactacagtaacacgactcaaagaaaatgtgaataaaaggcatctttgtttcccagtcaaattagctgattaagaaataaaacatcttaacatgtttttaaa

SEQ ID NO: 178460 - DNA, 2714 bp, Homo sapiens
  Payload ID: 15168
  Gene Symbol:
  Gene Name: RP5-850E9.3
  ENST ID: ENST00000488788
  CDS Start-End: 200-484
agctcccgcgatcccctgtctgcgcgccgccgccgccaagcccgagcccgagccggggccgccgccaccggtgccggctccgagcggcctcccgcgctccagcccgctgggagctgtccagtgctgaaaacccgcgcggacacagccgatcgcgcccggccggccgcctccccgcaccgagccccgcgccggccgcgccatgccgcgctccttcctggtaaagaagatcaaaggggacggcttccagtgcagcggggtgccggcccccacctaccaccccttggagacagcctacgtgctgcctggcgcccgggggcctcccggggacaacgacggggttcagaaagtgtcagcaactggtggaaggcaaagtagaaactcctggctccctccttcgtctccagttttctccagctggcagggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaattt

SEQ ID NO: 178461 - DNA, 1866 bp, Homo sapiens
  Payload ID: 15169
  Gene Symbol:
  Gene Name: RP5-860F19.8
  ENST ID: ENST00000380593
  CDS Start-End: 84-848
cacaatgccccgggtgcccactcccagaatgctgaccaaagtgggaggagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggactccttcctcaagtcaatgctgcaggttcctggtgtgaggggctgggggctttgagaagagggggcaagacagatggcttagccattggtgaaaattgcttagccaggggcagagcttgaccaagccactgatagcgcccatatggatgtgatgatacccgtggggcccccttggcaactgacagcatctttttctcatagccactcagctgtctcagcttcagactcactgagaacttctacctgggtaccactggccttgccattcctcccaccaatcccctctttccacttccaggagaaccacagactctagagagggtcccagtgacaaaaatctatcagggagaaggctggccagaagccccaggagacctcaactcactcgctctccaaaccttgcagcccacgcatcctcctccctagacttcctacttcctgcctcagtctgcatccccaagtctgagaaatgggccaactggggtcagacagcacctactcactctctaagaatcccaaggtctgttatggaaaaatgatcaagaaatcccatttcacccacttacacaatgtgtggccttggccaattaattcatttgagcctcaatgttacgtgggccacttctgtcatggggttgttgtgagtcaaagacaatatctatttgtgaagcattttgtagaagccaaaaacctgtaagatgttgttttgagctctaagaactttctgtaggcgcataagatcttttgaccccaaagactgttgaaggaacaggaagcttctctgggctttcagatcaactctctgtcctggatagaattttggccctaaaatggtaaacaagaggtcggttaagtgtgtacaagatgtaaaaggtcatgtgccatgaaatctcaaaatgtg

SEQ ID NO: 178462 - DNA, 2381 bp, Homo sapiens
  Payload ID: 15170
  Gene Symbol:
  Gene Name: RP5-864K19.6
  ENST ID: ENST00000454994
  CDS Start-End: 282-1826
ttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatat

SEQ ID NO: 178463 - DNA, 609 bp, Homo sapiens
  Payload ID: 15170
  Gene Symbol:
  Gene Name: RP5-864K19.6
  ENST ID: ENST00000621281
  CDS Start-End: 136-468
taagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacaca

SEQ ID NO: 178464 - DNA, 557 bp, Homo sapiens
  Payload ID: 15171
  Gene Symbol:
  Gene Name: RP5-874C20.8
  ENST ID: ENST00000621053
  CDS Start-End: 160-414
gaagaaagcgctccgaagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggacccagaccagccaaagaaacaaaaaatacttgtggaggagatggcccctctgaaaggagtacaggaacagcaggttcggcatgagtgtgaagttacaaagcctgagaaagagaaggccagtgatgaccccgaagacagacatttaccactgtgttggttttcaatcgaaatgatgtacataaatttggggcgtgcttgcaccgtccgaatgggcctggggtccggcggcggagagtgacctgggcggggcaggaggtggcagcgggggtcctcccggctcaccagagagacgagcggccgtgctcctagagaggcagggaacccgccagactccgccactccgctgcgggcgcggcgcagggagaagcttttgtacccgcc

SEQ ID NO: 178465 - DNA, 1531 bp, Homo sapiens
  Payload ID: 15172
  Gene Symbol:
  Gene Name: RP5-877J2.1
  ENST ID: ENST00000509504
  CDS Start-End: 1-1348
agaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaacatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctg

SEQ ID NO: 178466 - DNA, 5640 bp, Homo sapiens
  Payload ID: 15173
  Gene Symbol:
  Gene Name: RP5-966M1.6
  ENST ID: ENST00000468472
  CDS Start-End: 782-1072
caccatcgagcatggtttcctccctggtcctttccagaccccttactcccccctctctgaacttgcagttggaataggatagaggacaaggacatcagcaaaaacatgagcaactccccaggctccctttacctcactttctccacctgtgaacctgtggtagcccctctctgagtttgctgcaagggcccagtgagcttgccataatcagacgcagcagacacgggaagctcctgctctgccaccatgcagggatggaaaatctgtccactggaatccaggggaagggatggaagaggaagaaaaacaagcttggagcagtccaacccagctagggccctccattccctcagggacaccccacacccaccccacacactgggatgaacccttgcagaggaacaattcagatggtcacacattccaggacccaaatccgtaaacacaaagcatgtccgtcagtgccagcacctccccccggcgaatcaagcagctgtcccagagggcaaagggtctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacagaacgcttcctctcccctgctgtctctggggctgccaccctcccccacagtccaggcccttcagccaagggctctgcaccagcaccttggaagcaccaataaagaggatgcccacgtggccccagcaatcagaagcgattcctgggctccctctgctccaccaaatgactccccagtcacccctcaggagctgctggcactgtcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaaggtagtttgagggtttctgccagggggaggcatgacatccctgggggggagcttgagggaggtccattattgttcatctcccagctgttgggggagaggctccccaagttggccgggtgtggggagaggggacatagctgccctctccgcacccactcctgggtggatctcaagccctggctgtgaagacccacaccccacctgagagaagactgcatctgtcgatttctccaaagctggagctgctggctcccggatgaatttcagacctggggttctcagctccaggcaacttggactcccaggacctcctgatgttcctgaccatgctgcttaccaccccttccgccgtctggccatctgtaagctgccttccggccctgcgagggcctcggtttcccacggtggtccttgagcctgccccatagaggggggtggggtaaagcacgcaccacagggccaggccagggacggctgctgagggcacgatgtgaagtaattgtgggtcagttcaacctgggatcatttactggggctggggtgggagtgcatttcctaaggaggctgtcctcgccttcccagctctttgcagctgccccctgccccatccttagcgtctcatctcctcagatgcgagctcacccgggtcctttagctgcccctaggttgtcagaccacaggccatgacagagcagcctctcccacactccttgttcagaggggaccctaggccctaagaggggcacggactggccaagcatgcacatcacagcgctctttggagcagtccttgccagcttcctctctctgaaggcccctctccccactacccagtgtatggacatcaggcctcccctccccaaggcaggacttcacctgtcctttactttcactgagtaggatccactatactctagaggctgactcatgaggaaaccttctaggaagggagggcttcctccgttcagaaagccaacagaggtcccttgaactgttttctgatccccaaatctgcactcgaatgcagctgcacagccaggctggacctatccctgacagcatgctcttctgtttgaaaatctcctgtgacaaaggccattctaggtggagtgtatgtgtggcaggatggggggctggagcttggtggcagcgctgctggttgcccgcctcctgactgccttcctgctccctttctgtttccggatgttcctgccctagtgcctgcttcagcaccaccagccacctcaaatcctgatccagctgtgtctcgtgtcatgaatatgaaaatcgaaggtgcccccaaggccagaggccctgtcctaacagggggatcctgggaggggagtgacctgtcacatgtctcgatgttgaagtagtgagggaacccagccacacctagtcactgctccctccctcaacctcccactcctcaggaaggggctgcctaaacccagactttttcttcttttagaaacaaccatgacaacccaaaccccaggtaagttcccagcccccttggcccctttccacatccttgcccccagcctgcccttcctgctccaggagccgtgccccggctgtcccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaa

SEQ ID NO: 178467 - DNA, 954 bp, Homo sapiens
  Payload ID: 15174
  Gene Symbol:
  Gene Name: RP5-972B16.2
  ENST ID: ENST00000465127
  CDS Start-End: 108-947
agaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaag

SEQ ID NO: 178468 - DNA, 563 bp, Homo sapiens
  Payload ID: 15175
  Gene Symbol:
  Gene Name: RP6-24A23.6
  ENST ID: ENST00000563887
  CDS Start-End: 1-114
cgccgggtgccaagacccccggagagagaagattctgacaacgacgacgacactcacgtgagaatggattttgccagacgtgataatcagttcgactctcccaaaagagagtgattatattgccacaaaaacacattttagaagaaaagtgatgcttatggaattttatcttcgtctactccagatctgcctaaaggaaagaaaactcagaggcttctgagtagaaagcaacccaaatttctacaagcctacaagtggactctggcaattgaatgatcctattcatgcagatcattcatactgctgcttatggatccagtgatttctaattaacaatatttacactgtgctttgttttttgttttctggttttcctccccagtctgtccctttgaaaggaaacagatactatacaagtgagcatctcataactctttccctctttaaaaaaaagtaacttagaatacatataaatttggtcaatgccaattttaataatgtaaaatatttagattcaattttgaagttgaaaaactttaaaccagggcacataaagaaaaaac

SEQ ID NO: 178469 - DNA, 815 bp, Homo sapiens
  Payload ID: 15176
  Gene Symbol: RPAIN
  Gene Name: RPA interacting protein
  ENST ID: ENST00000327154
  CDS Start-End: 324-770
atggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagcctgtgatacttgggctgtgatcctctagagccagcttggactcacatcattctatggggttgaag

SEQ ID NO: 178470 - DNA, 1394 bp, Homo sapiens
  Payload ID: 15176
  Gene Symbol: RPAIN
  Gene Name: RPA interacting protein
  ENST ID: ENST00000381208
  CDS Start-End: 571-1089
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcatgcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178471 - DNA, 1535 bp, Homo sapiens
  Payload ID: 15176
  Gene Symbol: RPAIN
  Gene Name: RPA interacting protein
  ENST ID: ENST00000381209
  CDS Start-End: 571-1230
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178472 - DNA, 1083 bp, Homo sapiens
  Payload ID: 15176
  Gene Symbol: RPAIN
  Gene Name: RPA interacting protein
  ENST ID: ENST00000405578
  CDS Start-End: 12-707
gcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtttaatgcagtttattatctgaggaatttacctgcatagaaaagtgaaggtaacaagtcatttagactcaaaggccagtcagaaagaagggaagaggcagcatgggatcacggcaagaggattggtctgggagttaggacgcctggctccacacctgctcttctttgatcagtagtagtggttttggattcagctggtcatttcatagtcataagacccagataggccatgctggcaccacttttgcggaaggaaacagggcagaagcatagcagggcagcattaggtttgtctgtcagtggagtttttacagaggtccaagggctattcgctaacctgagtgaca

SEQ ID NO: 178473 - DNA, 1057 bp, Homo sapiens
  Payload ID: 15176
  Gene Symbol: RPAIN
  Gene Name: RPA interacting protein
  Uniprot ID: Q86UA6
  ENST ID: ENST00000536255
  CDS Start-End: 571-891
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgaca

SEQ ID NO: 178474 - DNA, 1471 bp, Homo sapiens
  Payload ID: 15176
  Gene Symbol: RPAIN
  Gene Name: RPA interacting protein
  Uniprot ID: Q86UA6
  ENST ID: ENST00000539417
  CDS Start-End: 571-1008
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaatcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178475 - DNA, 1359 bp, Homo sapiens
  Payload ID: 15176
  Gene Symbol: RPAIN
  Gene Name: RPA interacting protein
  ENST ID: ENST00000575599
  CDS Start-End: 571-891
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagtcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178476 - DNA, 1423 bp, Homo sapiens
  Payload ID: 15176
  Gene Symbol: RPAIN
  Gene Name: RPA interacting protein
  ENST ID: ENST00000571558
  CDS Start-End: 571-894
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178477 - DNA, 1282 bp, Homo sapiens
  Payload ID: 15176
  Gene Symbol: RPAIN
  Gene Name: RPA interacting protein
  ENST ID: ENST00000573577
  CDS Start-End: 571-894
cggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggtacaacctgagaatcacaagcggtgtggtggtgtgtcagtgtggcctgtccatcccatctcatgcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 178478 - DNA, 3817 bp, Homo sapiens
  Payload ID: 15176
  Gene Symbol: RPAIN
  Gene Name: RPA interacting protein
  ENST ID: ENST00000575112
  CDS Start-End: 27-350
gtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtttaatgcagtttattatctgaggaatttacctgcatagaaaagtgaaggtaacaagtcatttagactcaaaggccagtcagaaagaagggaagaggcagcatgggatcacggcaagaggattggtctgggagttaggacgcctggctccacacctgctcttctttgatcagtagtagtggttttggattcagctggtcatttcatagtcataagacccagataggccatgctggcaccacttttgcggaaggaaacagggcagaagcatagcagggcagcattaggtttgtctgtcagtggagtttttacagaggtccaagggctattcgctaacctgagtgacaactgaggtgtgagggccaggaacacaagtgggtaagggaaccacctgtcttagaagcgtgctataggaaccaatatctcttataatccatgtcctttccatatatgtgtatgtatgtatgtacatgtgtatatatatcacacaaacacacataaaaccaatatgatacgtattattattgcttttagatcccaggcagggggagccttgggattaggagcacactgtacttcaggaagttcatagccatggctttctactgggaatttagaattccttcatggccctgtcattccaaatgcagttaacctacagaggtcatttttattataagcagcattgcctggtaacagccatttcacctttatcaagtttcttccataggtattctactcattcattaaaaaaaaaatgaattgaggactcattaacattgagaaatacacatctctcacagagctcaagccttgggttggtaataagagaacagaataaacaggcagtaccctggagagctgtacaaggagggcttatgggagttcagaggagggtgatctcctttatggtgacaccttcctggaggaggcatttaacttggccttgaagcatggaatcgatctggacagacatggagatctggtgagttgtgggggtagagcttaagtggaagatccccacatagaagaacaaggcagagaagcaggaaactggagtatatacaaagagcatcttgttctacttagctggagcattaggttcatgagggagaggatagttcctgttaggaataggaaacagattcagagaagtgatgtaatctggccaaaattttactactaataagcgatagagctggtgttagaccccaggtctttgtggttccagtgcccctgctgtttcctgctccaggctcaggccttggtggaaggatgccattttccatcagcttgtatggaaagagacatagcaggtgaaagtttaaataaaacccctcactacttcctgttgactacaagcatatgttcccttctgttccagctatccagcactggtagcagatgctcaaatatgcagtgctttcaggcctctgtgctgttgtttaggctgttctgtctgaatgactttgactcctcccactacatttaaggatcatttgcacaaatatttaccaagcactacaatatgccgtgtacttcattcagcctgattcctcacaaggaattggccagtctcagctggccacggtggctcacgcctgtaatcccagcactttgggaggccgaggtgggcagatcacctgaggtcaggagtttaagaccagcctggccaacatggtgaaaccccatctttactaaaaatacaaaacttagctggacatggtggtgggtgcctgtaatctcagctactcgggaggctggggcaggagaatcgcttgaacccgggaggcggaggttgcagtgagctgagatcgtgctgctggattccagcctgggcaacagggtgagattctgtctcaaaaacagaattggtggctgagtgcggtggctcacgcctgtaatccccacactttgggaggctgaggcggtcggatcatctgaggtcaggagttcaagaccagcctggccaatatgatgaaaccctgtctctactaaaaatacaaaaaaattagtcaggcatggtggcacacacctgtaatcccagctactcgcgaggctgaggcaggagaatcacttgaacccaggaagcggaggttgcggtgagcagagattacgccactgctctccagcctgggcaacaagagtgaaactccatctcaaaaaaagcaaaacaaacaaaaaaagaattggccagcctgggaagtccattcctttggagtctgtgttaccattctcaataaacctaatgagggctggcagaggggaactggccagtctctccttgggctttcaccgtacctcatgccatgtcacctgtaacagtgttgtagttacctgcttatgtctttgtccttgagggcaaggcccatatttatttttatttccagtgcttggcatatattaataaagaggtgcttaagatgtttgtacaaatgagttaaggtggagggaggagagttgaggcacaggtcagctggctttggcttctgtcttcttagtaaggtgaacagtgagtcatccacacagattataatggtagcagagctggagtctacagctccttgagtatgaaagtccccttgagtgtgaaagacaaaatgctggtcgggggaagagaaggggaattaaaaggtaagtggaagatggcctaattgccaagtgtacagcttcagctcagcatataattgttatggaccccagttatccactcacctaaccgtcagtgccctgtggctcagagcagcagtgaagctaagtaggaggtgaggtttggaaggtgagtgctgtgcagcagtcttggagatcatagttgacagtgccggctctggggtgggcaggaagaccattgttgggtaagtgaggggaggtgggggtcacagcaaatatgagaaacacagccaggcactgtggttcacacctgtaaccccagcatttaggaaggctgaggtgggaggatcacttgaggccaggaattcaagaccagcctgggcaacatggtgaaaccctgtctctactaaaaatacagaaattagctgggtgtggtggctcgcacctgtactcccagctactcggaaggctgaagtgggaggatggcttgagctcaggaggcagaggttgcagtgagctgagagggcgccattgcgctccaggctgggtgacagcgagattgtgcctt

SEQ ID NO: 178479 - DNA, 561 bp, Homo sapiens
  Payload ID: 15176
  Gene Symbol: RPAIN
  Gene Name: RPA interacting protein
  ENST ID: ENST00000574003
  CDS Start-End: 10-330
gaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagtcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtt

SEQ ID NO: 178480 - DNA, 8195 bp, Homo sapiens
  Payload ID: 15177
  Gene Symbol: RPGRIP1L
  Gene Name: RPGRIP1-like
  Uniprot ID: Q68CZ1
  ENST ID: ENST00000262135
  CDS Start-End: 95-3802
atgtttctcccgtgctcctctcggccagccgcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctggagaccacaaacatctgcagactaaacctctccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagttttaaaatattcagtttcaaactattgcgaattttcacaacactcattttcatagctaattgctgctgacacattttgaagtggcgaggtagtattgaacgctgtcatgtggatacttcagttgggtttcataatctgtttgagaattttgtttgttttatcttgtggtaactggaggccattgaaaagcttaccaccttttgggttaaagagcagtggatttctcttggtgagccaaactggatccattgaagagggcttggcgtcaggggccaccagcagtggccttgccacacagataccagcttaaggtgttgctggtgtgaacatacacttcttggtgtaactagaccagtgcacgcagcacttttttgggctgtaatgcttttagtttggaaatacaaatagagatgtgatgtggtatgtgggagagtgtattttacatgtatttttgcctactgtagtagaaatgtcaaattcccagccactgtcatgaaaagcagttgacaaaaataagttttatggtttacagtgtggtttacgtaaagaacatttctcttcactctcagtttcaccatgttttctaaattatcatggtttactgccatttaacttaaattagtttttttaaaaatacataaagaatatgtttaatcaaataaagaaaggccacactgaaattctgctgttcctgccattcattcgttaccacaaaacacaaataatttctatgtgttatgaagacatgtgggctgagaagtggtcatgtgattggagaggttttgcgtgcactcatgttcccacaacaaaacataaattattttagtaatctgacatcaagagctgtgaaaatgaaaaccagttcttacacatgttctaacaagaatctgattaacatttttgtggatatggaaaattttttttttagtcaaactggcactattgctgaatgtagaatgatttccttatgcactagatagaaaaatgtgaatcatgtctgtgaacaaatatgagaataaaatgtcatctttgtgtaggacaaaacaaccaggagagagattttgggataaaaattatcaagtgattgacaatatcaggatgataattcatccccaactatcagagtacattttaataagtcactcatgcctgaaggcctctgactaccttaacaaagaaaaactaaacccgtgatttattagagattgggcaacatgcctaattaaatccatgaatgggaacaaacagatttacatcccctttgttcagaacaaaaacaacctctaggtcaaccagaaagctagaaaatatcaaagcaagagaaacaagtgtttttaaaactaaaaatatagaattagaaaacatctcctcatcctaatctcttttatcttacaaggtagaattttcacttccatttcaaagtgccaccagtggactgcaccctccagcctgaccgcctggaaaattggacccatattactggtattcttataccttttgttcttgccctttcattttccatatgacattcactaatatatcaagctatgtttttccttcaggcttttggaagtgcaatctggtactcttagacttcgatcatgacctgttttctgaggtagatgctgtttgacttttctgctttttgcctcttctcactctattgagagtcacctttttcatccctagaacagcattacctctgtcttcactgtgcaccatttgttttctttttaaataaaatttaacatcttgatttttatattcctactatctaatttgttcacatctatattcaactgaacatctcctcccatctgtctattctcctgcttatttttatctagtcaaagcacattttttttccttcctctttgctgtttttttcctttctctttactgtttcttttcttggtgagacagccacttcttgagataccgacatctgtgaccagtggccttcccaaaacgttcctttgtgttaagatttgtcttaatttaacatgacaggggcactcttagccattatgaaactgaggaaacagcaagctaatttttgtatctttgcttcttatacgtttttatagtgaagtaacagaggctggaactcagaaagctctcaggaatcactggtaaggaactgaagcataaggaagttttttaaaaattcaaggatatatgtcattaaaatccagctagatttgatgcaaatgttttgtcatagttacacat

SEQ ID NO: 178481 - DNA, 5297 bp, Homo sapiens
  Payload ID: 15177
  Gene Symbol: RPGRIP1L
  Gene Name: RPGRIP1-like
  Uniprot ID: Q68CZ1
  ENST ID: ENST00000379925
  CDS Start-End: 52-3999
tcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgagacttctcctcctcctgaagataggaaggaaatttcaccagaggtagagcatataccagaaatagaaattaatatgctgactgttccacatgttcccaaggtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagagtctcgcattgtctcccgggctggggtgcagtagcgcgatctcagctcactgcaacttccgcctcccgggttccagcgattttcctgcctcagcctcccaagtagatgggattacaggtgcctgccaccacacccagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaat

SEQ ID NO: 178482 - DNA, 1107 bp, Homo sapiens
  Payload ID: 15177
  Gene Symbol: RPGRIP1L
  Gene Name: RPGRIP1-like
  ENST ID: ENST00000562230
  CDS Start-End: 46-1107
ggcgctatagcaacggtagctagctgcagggccagtggcacggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaa

SEQ ID NO: 178483 - DNA, 2429 bp, Homo sapiens
  Payload ID: 15177
  Gene Symbol: RPGRIP1L
  Gene Name: RPGRIP1-like
  ENST ID: ENST00000568653
  CDS Start-End: 53-430
gtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaaggttcaaagaaaaggtgagacaaccattgaagaatgaaaatagggtttttctgcttagaatccatcctaaggaggtggttccagttcagtttctactctgtggacttcaacaacccactggcatgctatgtgcaggccttttactttgagttgggttttagtcatgatgatggctgttttcaagatttgtgactcacttgcctgattccttttctgaccattatcccacacacatcagccagtcagaatgaggcatgtagtctgctatgaccacctaacaatttttttctttgtaagcctaattggtcagtaaaagaatcgaattcacatccttgacctcattagtaatttgtcatagccagaaaataaaaaacaactgaataatgagccatgtagtttaatgggaaaaggactgagctaggaatcaagttgtatgtatgcattctgttatctctctgccactagcctgtggtatgtatgttcaagccatttaacctcctgaaagttcgttttactttagctacgagaataatgatccaatgaacactatgacccaaaagctctaaatgcctctcgatctcacaccactgactgtgacctagatacatgggtagaactgtctttaaatttatcttttagaagtaaataggccaggcacagtggctcacgcctgtaatcccagcactttgggaggctgaggcgggcggatcacttgaggtcaggagttcaagaccagcctggctaacatgatgaaaccccatttctactaaaaatacaaaaaattagctgggcatggtggcacaagcctgtaatcctagctactcggaggttgaggcaggaaaattgcttgaacccgggaggcagaggttgcagagccaagatcgcgccattggactgagcttgggcaataagagcgaaactctgtctaaaaaacaaaacaaaacaaaaaagtaaatagtttattttctataaatgtagattttataaactacctttttattttttaattttttttttttttttttttgagaggaagtctttgttgcccaggctggagtgcagtggtaagatctcggctcactgcaaccttcgcctcccgggttcaagtgattctcctgcctcagcctcccgagtagctgggatcacaggcgcctgccaccatacctggctaatttttatgttttagtagagacggggtttcaccatgttggccaggctggtctcaaatgaactccagacctcaggtgatccgtctgccttggcctcccaaagtgttgggattacagccatgagccacctcgtctagccaaaactacctttttaaataagcactcagactttgccagatcacgtatgattcattaatatgataaaataatcaaatccagcaaatggaatgtatggctattacgagacaaacagatgcaatcatgtttcttgacaaagtttatttgaatatcatttgaagaatttaaagataccctgccttaaaaattagggtcatttatttttacctgggtgttaactgcctttttatattaaatctgtgtctttcttttgaatgtaatctacatctctgtgtgaaagtctctctgtaacagaaaattcagatatttaggttgacgtctcattcatatgacaaccttacttttgtgcacaggccattgggtggggcttaggaccctaaactcattaaagggccaggtagagtgtgtggccctcttggactgtgatacctggccaaatttcccagtgatatatcattctcggaattaggtggaaaaggaactaatccattgattattttactagagtgtttgtggtactcttggatcttggtttttattatcctgtatcctttataaagcatgcttaatggatgtgcctcaagggaaagagaaaacaatcttaactgattatgttatgcatagctctccctgatgccacatgctgtaggccgagtagccagagtgtggatagacatgtattactaccgcatttacagcggactctgcttagggcagaaaaaaggttgttctatgacatcccaaagctattaaaggtttttttatttcacttttgttcccttaagtaaaagcttctgtccataaccacgctaaaataaagcaaaacccatttaaagaaaaa

SEQ ID NO: 178484 - DNA, 3877 bp, Homo sapiens
  Payload ID: 15177
  Gene Symbol: RPGRIP1L
  Gene Name: RPGRIP1-like
  ENST ID: ENST00000564374
  CDS Start-End: 95-3856
atgtttctcccgtgctcctctcggccagccgcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgagacttctcctcctcctgaagataggaaggaaatttcaccagaggtagagcatataccagaaatagaaattaatatgctgactgttccacatgttcccaaggtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatggtatgggtgaaagtgttgctcagtttgtgcaaccaacaattgctgaactccaaactctttattaaaaccttctttttgctggctcc

SEQ ID NO: 178485 - DNA, 4193 bp, Homo sapiens
  Payload ID: 15177
  Gene Symbol: RPGRIP1L
  Gene Name: RPGRIP1-like
  ENST ID: ENST00000563746
  CDS Start-End: 53-3898
gtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagagtctcgcattgtctcccgggctggggtgcagtagcgcgatctcagctcactgcaacttccgcctcccgggttccagcgattttcctgcctcagcctcccaagtagatgggattacaggtgcctgccaccacacccagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaa

SEQ ID NO: 178486 - DNA, 893 bp, Homo sapiens
  Payload ID: 15177
  Gene Symbol: RPGRIP1L
  Gene Name: RPGRIP1-like
  ENST ID: ENST00000566096
  CDS Start-End: 144-380
ctagagtccaaggagaactacatttcccaggaggctacgggagcctgccatgtttctcccgtgctcctctcggccagccgcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaaggttatgataaaaagcttttagctttttttcttgactcagtaaaatttggagggtatggtattttataaacttaattgaataccccaccttgaatcttgtttggaacaaggcaggatgtaaataagtacaatttttaaaaatggaaaatcttgcaaactagaataataaaccaaaaagattatgagtgtttattatgtctgaatttgctatttaaatgaaaaaagctaatagagtgccgttagtatatcatacctataaataacttttggtttaatatttatagtttaataagcaaatggccaaagcatctgttttttaaatgtcttgattttaaaatgaaagttttaaaaagtaactaactattctaacttgttagaatgcacattcccttaagatttggggtttactaatgaaaacatcacttcagtctctggaacatatttaactttgcttgggttatactagattctatattgatttcaaagagtctctactgtttctgaagaaacagtattgtcac

SEQ ID NO: 178487 - DNA, 651 bp, Homo sapiens
  Payload ID: 15177
  Gene Symbol: RPGRIP1L
  Gene Name: RPGRIP1-like
  ENST ID: ENST00000562588
  CDS Start-End: 284-651
ggtagctagctgcagggccagtggcacggtgagtacccgggaggatgggggaggatgagggtgggtggaggttgctgaccctccccactgcagcgcgggccggggtcctagggtccgctctgccgcctggagaaggccctggagttggccctggagttctgctggcgtgaaagcagcccagcccaagacacctccacatcctcaggcctgaatcacaggccgccctttatccccacgtccaggaccaatttgaaatgttatatcccagccatgaagctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttga

SEQ ID NO: 178488 - DNA, 465 bp, Homo sapiens
  Payload ID: 15177
  Gene Symbol: RPGRIP1L
  Gene Name: RPGRIP1-like
  ENST ID: ENST00000569716
  CDS Start-End: 298-465
gtggcacggtgagtacccgggaggatgggggaggatgagggtgggtggaggttgctgaccctccccactgcagcgcgggccggggtcctagggtccgctctgccgcctggagaaggccctggagttggccctggagttctgctggcgtgaaagcagcccagcccaagacacctccacatcctcaggcctgaatcacaggccgccctttatccccacgtccaggaccaatttgaaatgttatatcccagccatgaaggttcttgctccgttgcccaggctggagtgcagtgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgt

SEQ ID NO: 178489 - DNA, 6038 bp, Homo sapiens
  Payload ID: 15177
  Gene Symbol: RPGRIP1L
  Gene Name: RPGRIP1-like
  ENST ID: ENST00000621565
  CDS Start-End: 65-3874
gcccgccacgctgtcggcgctatagcaacggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgagacttctcctcctcctgaagataggaaggaaatttcaccagaggtagagcatataccagaaatagaaattaatatgctgactgttccacatgttcccaaggtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctggagaccacaaacatctgcagactaaacctctccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagtttt

SEQ ID NO: 178490 - DNA, 948 bp, Homo sapiens
  Payload ID: 15178
  Gene Symbol: RPL17-C18orf32
  Gene Name: RPL17-C18orf32 readthrough
  ENST ID: ENST00000332968
  CDS Start-End: 109-681
ctctttccctaagcagcctgaggtgatctgtgaaaatggttcgctattcacttgacccggagaaccccacgaaataacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcat

SEQ ID NO: 178491 - DNA, 1012 bp, Homo sapiens
  Payload ID: 15178
  Gene Symbol: RPL17-C18orf32
  Gene Name: RPL17-C18orf32 readthrough
  ENST ID: ENST00000577910
  CDS Start-End: 16-570
aggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgta

SEQ ID NO: 178492 - DNA, 1440 bp, Homo sapiens
  Payload ID: 15178
  Gene Symbol: RPL17-C18orf32
  Gene Name: RPL17-C18orf32 readthrough
  ENST ID: ENST00000584895
  CDS Start-End: 16-702
aggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgta

SEQ ID NO: 178493 - DNA, 562 bp, Homo sapiens
  Payload ID: 15179
  Gene Symbol: RPL36A-HNRNPH2
  Gene Name: RPL36A-HNRNPH2 readthrough
  ENST ID: ENST00000409170
  CDS Start-End: 33-389
tttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgtt

SEQ ID NO: 178494 - DNA, 572 bp, Homo sapiens
  Payload ID: 15179
  Gene Symbol: RPL36A-HNRNPH2
  Gene Name: RPL36A-HNRNPH2 readthrough
  ENST ID: ENST00000409338
  CDS Start-End: 34-267
ctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaat

SEQ ID NO: 178495 - DNA, 876 bp, Homo sapiens
  Payload ID: 15180
  Gene Symbol: RPS10-NUDT3
  Gene Name: RPS10-NUDT3 readthrough
  ENST ID: ENST00000605528
  CDS Start-End: 18-876
accctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttgtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcga

SEQ ID NO: 178496 - DNA, 7505 bp, Homo sapiens
  Payload ID: 15181
  Gene Symbol: RICTOR
  Gene Name: RPTOR independent companion of MTOR, complex 2
  Uniprot ID: Q6R327
  ENST ID: ENST00000296782
  CDS Start-End: 23-5221
gttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagagagaattttagcaccctatactgattttcactacagacatagtccagatacagctgaaggacagctcaaagaagacagagaagcacgatttctagccagtaaaatgggaatcatagcaacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaatgaaacccgaaagaagtcttcaaaataatggtttattgaccacccttagtcaacactactttttatttattggaacactttcttgccaccctcatggagttaaaatgctggaaaaatgcagtgtatttcagtgtctccttaatctttgctccttgaaaaaccaagatcacttgctaaaacttactgtttctagcttggactatagcagagatggattggctagagtcatcctttccaaaattttaactgcagctactgatgcctgcagactctatgcaacaaaacatttaagggtattattgagagctaatgttgaattctttaataattggggaattgagttgttagtgacccagctacatgataaaaacaaaacgatttcctctgaagctcttgatatcctcgatgaagcatgtgaagacaaggccaatcttcatgctctcattcagatgaaaccagcgttatcccaccttggagacaagggtttgcttctcctgctgagatttctctccattccaaaaggattttcctatctgaatgaaagaggttatgtagcaaaacaattggaaaagtggcacagggaatacaactccaaatatgttgacttgattgaggaacaactcaatgaagcacttactacttaccggaagcctgttgatggtgataactatgttcgtcggagtaaccaaagattacagcgtcctcacgtctacctgcctatacacctttatggacaactagtacaccataaaacaggctgccatttgttggaagtacagaatattattacagaactctgtcgtaatgttcgtacaccagatttggataagtgggaagaaattaaaaaactgaaagcatctctttgggccttgggaaatatcggctcatcaaattggggtctcaatttgctacaggaagaaaacgtgattccagatatactaaaacttgcaaaacagtgtgaagttctttccatcagagggacctgtgtatatgtacttgggctcatagctaaaaccaaacaaggctgtgatattctaaaatgtcacaactgggatgctgtgaggcatagtcgcaaacatctgtggccagtggttccagatgatgtggaacaactctgtaatgaactttcatctatcccaagcactctaagtttgaactcggagtcaaccagctctagacataatagtgaaagtgaatctgtgccatcgagtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggatcgattttaaaaagaagcatgtcgggggaatcaggagcttaagacctacaataacaaacaaccttttcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtcatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaa

SEQ ID NO: 178497 - DNA, 9543 bp, Homo sapiens
  Payload ID: 15181
  Gene Symbol: RICTOR
  Gene Name: RPTOR independent companion of MTOR, complex 2
  Uniprot ID: Q6R327
  ENST ID: ENST00000357387
  CDS Start-End: 32-5158
gtttccggtgttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagagagaattttagcaccctatactgattttcactacagacatagtccagatacagctgaaggacagctcaaagaagacagagaagcacgatttctagccagtaaaatgggaatcatagcaacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaatgaaacccgaaagaagtcttcaaaataatggtttattgaccacccttagtcaacactactttttatttattggaacactttcttgccaccctcatggagttaaaatgctggaaaaatgcagtgtatttcagtgtctccttaatctttgctccttgaaaaaccaagatcacttgctaaaacttactgtttctagcttggactatagcagagatggattggctagagtcatcctttccaaaattttaactgcagctactgatgcctgcagactctatgcaacaaaacatttaagggtattattgagagctaatgttgaattctttaataattggggaattgagttgttagtgacccagctacatgataaaaacaaaacgatttcctctgaagctcttgatatcctcgatgaagcatgtgaagacaaggccaatcttcatgctctcattcagatgaaaccagcgttatcccaccttggagacaagggtttgcttctcctgctgagatttctctccattccaaaaggattttcctatctgaatgaaagaggttatgtagcaaaacaattggaaaagtggcacagggaatacaactccaaatatgttgacttgattgaggaacaactcaatgaagcacttactacttaccggaagcctgttgatggtgataactatgttcgtcggagtaaccaaagattacagcgtcctcacgtctacctgcctatacacctttatggacaactagtacaccataaaacaggctgccatttgttggaagtacagaatattattacagaactctgtcgtaatgttcgtacaccagatttggataagtgggaagaaattaaaaaactgaaagcatctctttgggccttgggaaatatcggctcatcaaattggggtctcaatttgctacaggaagaaaacgtgattccagatatactaaaacttgcaaaacagtgtgaagttctttccatcagagggacctgtgtatatgtacttgggctcatagctaaaaccaaacaaggctgtgatattctaaaatgtcacaactgggatgctgtgaggcatagtcgcaaacatctgtggccagtggttccagatgatgtggaacaactctgtaatgaactttcatctatcccaagcactctaagtttgaactcggagtcaaccagctctagacataatagtgaaagtgaatctgtgccatcgagtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtcatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaagtctacgcttaaatttatagtgctatttggtttctccatgatttcactgacaggtctaatacattttctttgagtacttgtttgtaaaaagtagactttatggtgaaaaatacatgcagtgccaagtgattaacttaagtgtttaaaaatattaaattatagcagaagaggttaggaatgatatcagcagtaatagaaataattgagaaaatcatctataaataatagatattacagactatagaataccaaaataatgtcaatactgtagtttttaaagattttaggattaatcttagtccatataaatttgtactattggtaattattgaataattgggaggaatctgggcagttgtgctggttgtaaactatgaatttctaatcgtaaagtgaattgttatttctaattgaactttttttcaagaacagatttcagcctcacatactaagtaaatactgataaataaggaaattagaaatttagtattcataattaaatatgctctaaaatttcctatacttttatttcctgtttattcttaggtagattggaagggggaaacagtctgttctccctaattaaattttttctaataacgattagtagaatatggacattctatatgacagtgacattaaaagaggctctttggaagtatatacattattaacataatgtgtacaagtccttttgaaatgacaactttaatgggtttcagctcttttatctagagcttgagataattcaagctgagtttttcagggcatatcacaacggccaagtgttcagcagtgggatatcaatgcttatttacattttcctactgctatttatataaaatgttattccattcagaggatgccttttatccccacattaaagcacagatcattaagcaataaaaaccaaattgtctgtcattcaaattataactgcagttatttttgcatggtaagagtgaggtgctaattttgtgtgagatgaactttgtaaactactttgggaaatgttctttggaagtaaggttttttctcctttagtcttatgcttccacttttgtctcagattcacaatccattaaaacatggggaaaaaagaaaaggtaaaattgagagacttttgttagaggagctatttggaatgaaccaacatttcagattttccaaaatgtaagttaggaagtctccattgtctctgcattaacaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttagcacaaaatgcaaagtcttggggcagagagggggagtgaaaaaaattttataggtaattgttacaaaaatacctgtcagaaaccctaaagctgcattgtaaaacaaatggtgtaaactagttttgaaaagtggtaaggaattgtgaaaaaaatctcagacttaatgctctctaaccacatgagtttcttcttttttatttagtaatacgctgctacatatttggaggttctggtgtttgtaggtcactgaacagacattgaaatctgatttatattgtataactgtaacatagaaagaaaaagtatttatattttttctgtaagaatatttcattgagttgtgtataatttaaataagatttgtccccaaatggttttgctcaccttgattttttttgttgtgattttcttgtttttgtataatgtgtatagtttatgtcaagggcattaaaagcctcctgaagcataatcttatcaaagggatacattgttaataaaatgtacttaaaattcttaaac

SEQ ID NO: 178498 - DNA, 7312 bp, Homo sapiens
  Payload ID: 15181
  Gene Symbol: RICTOR
  Gene Name: RPTOR independent companion of MTOR, complex 2
  Uniprot ID: Q6R327
  ENST ID: ENST00000511516
  CDS Start-End: 13-786
aaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagagaattttagcaccctatactgattttcactacagacatagtccagatacagctgaaggacagctcaaagaagacagagaagcacgatttctagccagtaaaatgggaatcatagcaacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaatgaaacccgaaagaagtcttcaaaataatggtttattgaccacccttagtcaacactactttttatttattggaacactttcttgccaccctcatggagttaaaatgctggaaaaatgcagtgtatttcagtgtctccttaatctttgctccttgaaaaaccaagatcacttgctaaaacttactgtttctagcttggactatagcagagatggattggctagagtcatcctttccaaaattttaactgcagctactgatgcctgcagactctatgcaacaaaacatttaagggtattattgagagctaatgttgaattctttaataattggggaattgagttgttagtgacccagctacatgataaaaacaaaacgatttcctctgaagctcttgatatcctcgatgaagcatgtgaagacaaggccaatcttcatgctctcattcagatgaaaccagcgttatcccaccttggagacaagggtttgcttctcctgctgagatttctctccattccaaaaggattttcctatctgaatgaaagaggttatgtagcaaaacaattggaaaagtggcacagggaatacaactccaaatatgttgacttgattgaggaacaactcaatgaagcacttactacttaccggaagcctgttgatggtgataactatgttcgtcggagtaaccaaagattacagcgtcctcacgtctacctgcctatacacctttatggacaactagtacaccataaaacaggctgccatttgttggaagtacagaatattattacagaactctgtcgtaatgttcgtacaccagatttggataagtgggaagaaattaaaaaactgaaagcatctctttgggccttgggaaatatcggctcatcaaattggggtctcaatttgctacaggaagaaaacgtgattccagatatactaaaacttgcaaaacagtgtgaagttctttccatcagagggacctgtgtatatgtacttgggctcatagctaaaaccaaacaaggctgtgatattctaaaatgtcacaactgggatgctgtgaggcatagtcgcaaacatctgtggccagtggttccagatgatgtggaacaactctgtaatgaactttcatctatcccaagcactctaagtttgaactcggagtcaaccagctctagacataatagtgaaagtgaatctgtgccatcgagtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtcatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaagtcta

SEQ ID NO: 178499 - DNA, 686 bp, Homo sapiens
  Payload ID: 15181
  Gene Symbol: RICTOR
  Gene Name: RPTOR independent companion of MTOR, complex 2
  ENST ID: ENST00000514735
  CDS Start-End: 13-686
aaacccgtcaatatggcggcgatcggccgcggccgctctctgaagaacctccgagtacgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcg

SEQ ID NO: 178500 - DNA, 3762 bp, Homo sapiens
  Payload ID: 15182
  Gene Symbol: RRN3
  Gene Name: RRN3 homolog, RNA polymerase I transcription factor
  Uniprot ID: Q9NYV6
  ENST ID: ENST00000198767
  CDS Start-End: 85-2040
acgcgcaacttccgggacagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 178501 - DNA, 2039 bp, Homo sapiens
  Payload ID: 15182
  Gene Symbol: RRN3
  Gene Name: RRN3 homolog, RNA polymerase I transcription factor
  Uniprot ID: Q9NYV6
  ENST ID: ENST00000327307
  CDS Start-End: 68-1924
acagaaatgagctcattcctcctaactgggtaatagacatgggtggggcctggaaaagatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctg

SEQ ID NO: 178502 - DNA, 2198 bp, Homo sapiens
  Payload ID: 15182
  Gene Symbol: RRN3
  Gene Name: RRN3 homolog, RNA polymerase I transcription factor
  ENST ID: ENST00000429751
  CDS Start-End: 17-1882
gcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaagagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggt

SEQ ID NO: 178503 - DNA, 1001 bp, Homo sapiens
  Payload ID: 15182
  Gene Symbol: RRN3
  Gene Name: RRN3 homolog, RNA polymerase I transcription factor
  Uniprot ID: Q9NYV6
  ENST ID: ENST00000564131
  CDS Start-End: 21-938
ggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggttagcagtttattaatgaaagtggagatgaagtttatcataaagggtggaaacagctagtgctgctcatctttgttaaggctttagattgaaagaattaaaatagttcagcaaacttgaaaa

SEQ ID NO: 178504 - DNA, 2128 bp, Homo sapiens
  Payload ID: 15182
  Gene Symbol: RRN3
  Gene Name: RRN3 homolog, RNA polymerase I transcription factor
  ENST ID: ENST00000563559
  CDS Start-End: 79-1995
aacttccgggacagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtttttaatgtagaaagacatttacatataagtctgtttaatttcaaaggagtttgtgaaaaaaaatccatggtgaaaatgaaacaatgacatggttaatctggaacttacgttcttataccaataaaaggtacctcaata

SEQ ID NO: 178505 - DNA, 3762 bp, Homo sapiens; identical to SEQ ID NO: 178500
  Payload ID: 15182
  Gene Symbol: RRN3
  Gene Name: RRN3 homolog, RNA polymerase I transcription factor
  Uniprot ID: Q9NYV6
  ENST ID: ENST00000616334
  CDS Start-End: 85-2040

SEQ ID NO: 178506 - DNA, 2128 bp, Homo sapiens; identical to SEQ ID NO: 178504
  Payload ID: 15182
  Gene Symbol: RRN3
  Gene Name: RRN3 homolog, RNA polymerase I transcription factor
  ENST ID: ENST00000632447
  CDS Start-End: 79-1995

SEQ ID NO: 178507 - DNA, 1001 bp, Homo sapiens; identical to SEQ ID NO: 178503
  Payload ID: 15182
  Gene Symbol: RRN3
  Gene Name: RRN3 homolog, RNA polymerase I transcription factor
  Uniprot ID: Q9NYV6
  ENST ID: ENST00000634151
  CDS Start-End: 21-938

SEQ ID NO: 178508 - DNA, 2198 bp, Homo sapiens; identical to SEQ ID NO: 178502
  Payload ID: 15182
  Gene Symbol: RRN3
  Gene Name: RRN3 homolog, RNA polymerase I transcription factor
  ENST ID: ENST00000631800
  CDS Start-End: 17-1882

SEQ ID NO: 178509 - DNA, 2039 bp, Homo sapiens; identical to SEQ ID NO: 178501
  Payload ID: 15182
  Gene Symbol: RRN3
  Gene Name: RRN3 homolog, RNA polymerase I transcription factor
  Uniprot ID: Q9NYV6
  ENST ID: ENST00000632541
  CDS Start-End: 68-1924

SEQ ID NO: 178510 - DNA, 2621 bp, Homo sapiens
  Payload ID: 15183
  Gene Symbol: RSPO1
  Gene Name: R-spondin 1
  Uniprot ID: Q2MKA7
  ENST ID: ENST00000356545
  CDS Start-End: 714-1505
attccctccctggtgctcgcagaggactggcccctctccgggctgggagctccggccgagcggaggcgcgacggagagcaccagcgcagggcagagagcccggagcgaccggccagagtagggcatccgctcgggtgctgcggagaacgagggcagctccgagccgccccggaggaccgatgcgccgggtggggcgctggccccgagggcgtgagccgtccgcagattgagcaacttgggaacgggcgggcggagcgcaggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggg

SEQ ID NO: 178511 - DNA, 2320 bp, Homo sapiens
  Payload ID: 15183
  Gene Symbol: RSPO1
  Gene Name: R-spondin 1
  Uniprot ID: Q2MKA7
  ENST ID: ENST00000401068
  CDS Start-End: 586-1377
cgcgccctcgcccctcccgggcctgcccccgtcgcgactggcagcacgaagctgagattgtggtttcctggtgattcaggtgggagtgggccagaagatcaccgctggcaaggactggtgtttgtcaactgtaaggactcatggaacagatctaccagggattctcagaccttagtttgagaaatgctgcaattaaaggcaaatcctatcactctgagtgatcgctttggtgtcgaggcaatcaaccataaagataaatgcaaatatggaaattgcataacagtactcagtattaaggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgct

SEQ ID NO: 178512 - DNA, 2463 bp, Homo sapiens
  Payload ID: 15183
  Gene Symbol: RSPO1
  Gene Name: R-spondin 1
  Uniprot ID: Q2MKA7
  ENST ID: ENST00000612451
  CDS Start-End: 456-1058
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgaggtatctttgaggaagtctctctttgaggacctccctttgagctgatggagaactgggctccccacaccctctctgtccccagctgagattatggtggatttgggctacggcccaggcctgggcctcctgctgctgacccagccccagaggtgttagcaagagccgtgtgctatccaccctccccgagaccacccctccgaccaggggcctggagctggcgcgtgactatgcggcttgggctgtgtgtggtggccctggttctgagctggacgcacctcaccatcagcagccgggggatcaaggggaaaaggcagaggcggatcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 178513 - DNA, 2331 bp, Homo sapiens
  Payload ID: 15183
  Gene Symbol: RSPO1
  Gene Name: R-spondin 1
  Uniprot ID: Q2MKA7
  ENST ID: ENST00000615459
  CDS Start-End: 216-926
aggcgagccgggcgcccaggacagtcccgcagcgggcgggtgagcgggccgcgccctcgcccctcccgggcctgcccccgtcgcgactggcagcacgaagctgagattgtggtttcctggtgattcaggtgggagtgggccagaagatcaccgctggcaaggactgggttggtttttggagtagtccctgctgacgtgacaaaaagatctctcatatgatattccgagtcagtgccgaggggagccaggcctgtgccaaaggctgtgagctctgctctgaagtcaacggctgcctcaagtgctcacccaagctgttcatcctgctggagaggaacgacatccgccaggtgggcgtctgcttgccgtcctgcccacctggatacttcgacgcccgcaaccccgacatgaacaagtgcatcaaatgcaagatcgagcactgtgaggcctgcttcagccataacttctgcaccaagtgtaaggagggcttgtacctgcacaagggccgctgctatccagcttgtcccgagggctcctcagctgccaatggcaccatggagtgcagtagtcctgcgcaatgtgaaatgagcgagtggtctccgtgggggccctgctccaagaagcagcagctctgtggtttccggaggggctccgaggagcggacacgcagggtgctacatgcccctgtgggggaccatgctgcctgctctgacaccaaggagacccggaggtgcacagtgaggagagtgccgtgtcctgaggggcagaagaggaggaagggaggccagggccggcgggagaatgccaacaggaacctggccaggaaggagagcaaggaggcgggtgctggctctcgaagacgcaaggggcagcaacagcagcagcagcaagggacagtggggccactcacatctgcagggcctgcctagggacactgtccagcctccaggcccatgcagaaagagttcagtgctactctgcgtgattcaagctttcctgaactggaacgtcgggggcaaagcatacacacacactccaatccatccatgcatacatagacacaagacacacacgctcaaacccctgtccacatatacaaccatacatacttgcacatgtgtgttcatgtacacacgcagacacagacaccacacacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgttactcagagcatggcccggcagcagtgttgtcacagggcagcttgttaggaatgagaatctcaggtctcattccagacctggtgagccagagtctaaattttaagattcctgatgattggcatgttacccaaatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaattgtacaaacacatatataactacaaaaggatggtgccaagggcaggtgaccactggcatctatgcttagctatgaaagtgaataaagcagaataaaaataaaatactttctctcagg

SEQ ID NO: 178514 - DNA, 3111 bp, Homo sapiens
  Payload ID: 15184
  Gene Symbol: RSPO2
  Gene Name: R-spondin 2
  Uniprot ID: Q6UXX9
  ENST ID: ENST00000276659
  CDS Start-End: 622-1353
acttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatt

SEQ ID NO: 178515 - DNA, 2748 bp, Homo sapiens
  Payload ID: 15184
  Gene Symbol: RSPO2
  Gene Name: R-spondin 2
  Uniprot ID: Q6UXX9
  ENST ID: ENST00000517781
  CDS Start-End: 450-989
gcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtgggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 178516 - DNA, 674 bp, Homo sapiens
  Payload ID: 15184
  Gene Symbol: RSPO2
  Gene Name: R-spondin 2
  ENST ID: ENST00000521502
  CDS Start-End: 171-674
acctcactgttttagtatctgtgagacacagatgtgaaagctacagatttaattaacatgcagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttc

SEQ ID NO: 178517 - DNA, 2487 bp, Homo sapiens
  Payload ID: 15184
  Gene Symbol: RSPO2
  Gene Name: R-spondin 2
  Uniprot ID: Q6UXX9
  ENST ID: ENST00000517939
  CDS Start-End: 198-728
cttttttctggaaactgcgacgagatgggaactttctgaattaagcagcaattcccgcgctggttttctggggagtcctcgcctccagagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatta

SEQ ID NO: 178518 - DNA, 602 bp, Homo sapiens
  Payload ID: 15184
  Gene Symbol: RSPO2
  Gene Name: R-spondin 2
  ENST ID: ENST00000520026
  CDS Start-End: 334-602
attttttgcctgtgtttagacacagaggttggtgtagtgaccatgtggtagatggagaagttcttgtggaattactaagctattgatttacaacagggagaatgccactaaaatagtggacaatggtgaattaaatggaaaagtctgtttgaggtttggggcaagaagcttcaaattgtaaaaatcacatgggctcttgtccttcagcactgagcagcatcatgattgaagattggagaaagtggggagagagtactcaggttaggtgtggttcacatcacttttgctttaagggaattcctcgtgtgtagggttataaagataacctaagatatggacttggctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggctttta

SEQ ID NO: 178519 - DNA, 562 bp, Homo sapiens
  Payload ID: 15184
  Gene Symbol: RSPO2
  Gene Name: R-spondin 2
  ENST ID: ENST00000521956
  CDS Start-End: 199-562
acaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagag

SEQ ID NO: 178520 - DNA, 579 bp, Homo sapiens
  Payload ID: 15184
  Gene Symbol: RSPO2
  Gene Name: R-spondin 2
  ENST ID: ENST00000521757
  CDS Start-End: 313-579
atttcttggcctgggttgaggaccttgccctaagttctacctctgtctggtctgacatccccatgagccattcagctttagcttctggcctcaactctgcctctgagtttcctctttgtttctaagtttggttgtgtattaacaactttttgggtggaggaggtagagggaagaaggggagggatattttatttagtatttctatctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgt

SEQ ID NO: 178521 - DNA, 568 bp, Homo sapiens
  Payload ID: 15184
  Gene Symbol: RSPO2
  Gene Name: R-spondin 2
  ENST ID: ENST00000522333
  CDS Start-End: 339-568
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattc

SEQ ID NO: 178522 - DNA, 2697 bp, Homo sapiens
  Payload ID: 15185
  Gene Symbol: RSPO3
  Gene Name: R-spondin 3
  Uniprot ID: Q9BXY4
  ENST ID: ENST00000356698
  CDS Start-End: 590-1408
tccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcct

SEQ ID NO: 178523 - DNA, 1290 bp, Homo sapiens
  Payload ID: 15185
  Gene Symbol: RSPO3
  Gene Name: R-spondin 3
  Uniprot ID: Q9BXY4
  ENST ID: ENST00000368317
  CDS Start-End: 156-1034
gccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaaaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattgtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggggattgaagtcaccctagctgaaggcctcaccagtgtttcacagaggacacagcccaccccttgcaggaggaggtatctctgagtgtgcagcacagaatcgcatgacccaccttaaccttcctgttgtcatggaaggatgcacggctgctctgtccactgtgattcctagccctctcaagatcactgctttctgaagaatttgcaatgactctggcttctggctgcttatctctggacacccgttctccaccagttgtacagttcatgtaatctacttggcttaattgattttccacttctctcttcctcttctaagatataaacattttaaatgattt

SEQ ID NO: 178524 - DNA, 2707 bp, Homo sapiens
  Payload ID: 15186
  Gene Symbol: RSPO4
  Gene Name: R-spondin 4
  Uniprot ID: Q2I0M5
  ENST ID: ENST00000217260
  CDS Start-End: 98-802
cacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccagggggagtgtgaactgggtccctggggcggctggagcccctgcacacacaatggaaagacctgcggctcggcttggggcctggagagccgggtacgagaggctggccgggctgggcatgaggaggcagccacctgccaggtgctttctgagtcaaggaaatgtcccatccagaggccctgcccaggagagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctccatttgtcctctctttctttccacccttctatcatttttctgtcagtctaccttccctttctttttcttttttatttcctttatttcttccacctccattctcctctcctttctccctccctccttcccttccttcctcttctttctcacttatcttttatctttccttttctttcttcctgtgtttcttcctgtccttcaccgcatccttctctctctccctcctcttgtctccctctcacacacactttaagagggaccatgagcctgtgccctcccctgcagctttctctatctacaacttaaagaaagcaaacatcttttcccaggcctttccctgaccccatctttgcagagaaagggtttccagagggcaaagctgggacacagcacaggtgaatcctgaaggccctgcttctgctctgggggaggctccaggaccctgagctgtgagcacctggttctctggacagtccccagaggccatttccacagccttcagccaccagccaccccgaggagctggctggacaaggctccagggcttccagaggcctggcttggacacctcccccagctggccgtggagggtcacaacctggcctctgggtgggcagccagccctggagggcatcctctgcaagctgcctgccaccctcatcggcactcccccacaggcctccctctcatgggttccatgcccctttttcccaagccggatcaggtgagctgtcactgctgggggatccacctgcccagcccagaagaggccactgaaacggaaaggaaagctgagattatccagcagctctgttccccacctcagcgcttcctgcccatgtggggaaacaggtctgagaaggaaggggcttgcccagggtcacacaggaagccttcaggctctgcttctgcctgatggctctgctcagcacattcacggtggagaggagaatttgggggtcacttgaggggggaaatgtagggaattgtgggtggggagcaagggaagatccgtgcactcgtccacacccaccaccacactcgctgacacccacccccacacgctgacacccacccccacacttgcccacacccatcaccgcactcgcccacacccaccaccacactgccccacacccaccaccacactcccccacacccaccaccacactcgcccacacccaccaccagtgacttgagcatctgtgcttcgctgtgacgcccctcgccctaggcaggaacgacgctgggaggagtctccaggtcagacccagcttggaagcaagtctgtcctcactgcctatccttctgccatcataacacccccttcctgctctgctccccggaatcctcagaaacgggatttgtatttgccgtgactggttggcctgaacacgtagggctccgtgactgggacaggaatgggcaggagaagcaagagtcggagctccaaggggcccaggggtggcctggggaaggaagatggtcagcaggctgggggagaggctctaggtgatgaaatattacattcccgaccccaagagagcacccaccctcagacctgccctccacctggcagctggggagccctggcctgaacccccccctcccagcaggcccaccctctctctgacttccctgctctcacctccccgagaacagctagagccccctcctccgcctggccaggccaccagcttctcttctgcaaacgtttgtgcctctgaaatgctccgttgttattgtttcaagaccctaacttttttttaaaactttcttaataaagggaaaagaaacttgtaaa

SEQ ID NO: 178525 - DNA, 722 bp, Homo sapiens
  Payload ID: 15186
  Gene Symbol: RSPO4
  Gene Name: R-spondin 4
  Uniprot ID: Q2I0M5
  ENST ID: ENST00000400634
  CDS Start-End: 101-619
gcccacagcagcccccgcgcccgccgtgccgccgccgggacgtggggcccttgggccgtcgggccgcctggggagcgccagcccggatccggctgcccagatgcgggcgccactctgcctgctcctgctcgtcgcccacgccgtggacatgctcgccctgaaccgaaggaagaagcaagtgggcactggcctggggggcaactgcacaggctgtatcatctgctcagaggagaacggctgttccacctgccagcagaggctcttcctgttcatccgccgggaaggcatccgccagtacggcaagtgcctgcacgactgtccccctgggtacttcggcatccgcggccaggaggtcaacaggtgcaaaaaatgtggggccacttgtgagagctgcttcagccaggacttctgcatccggtgcaagaggcagttttacttgtacaaggggaagtgtctgcccacctgcccgccgggcactttggcccaccagaacacacgggagtgccaggagaggagccccggccagaagaagggcaggaaggaccggcgcccacgcaaggacaggaagctggaccgcaggctggacgtgaggccgcgccagcccggcctgcagccctgaccgccggctctcccgactctctggtcctagtcctcggcccctgcacacctcctcctgctccttctcctcctctcctcttactctttctcctctgtcttctcca

SEQ ID NO: 178526 - DNA, 4824 bp, Homo sapiens
  Payload ID: 15187
  Gene Symbol: RTEL1-TNFRSF6B
  Gene Name: RTEL1-TNFRSF6B readthrough (NMD candidate)
  ENST ID: ENST00000492259
  CDS Start-End: 104-2461
caggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 178527 - DNA, 4931 bp, Homo sapiens
  Payload ID: 15187
  Gene Symbol: RTEL1-TNFRSF6B
  Gene Name: RTEL1-TNFRSF6B readthrough (NMD candidate)
  ENST ID: ENST00000482936
  CDS Start-End: 1-4203
atgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 178528 - DNA, 5021 bp, Homo sapiens
  Payload ID: 15188
  Gene Symbol: RTF1
  Gene Name: RTF1 homolog, Paf1/RNA polymerase II complex component
  Uniprot ID: Q92541
  ENST ID: ENST00000389629
  CDS Start-End: 13-2145
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaactgtaccaatattgtaaataaatgttatgccattttaacaaaggga

SEQ ID NO: 178529 - DNA, 551 bp, Homo sapiens
  Payload ID: 15188
  Gene Symbol: RTF1
  Gene Name: RTF1 homolog, Paf1/RNA polymerase II complex component
  ENST ID: ENST00000560447
  CDS Start-End: 1-515
gtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggtaagaaaactttatctgaatcactaaaacaaagttaattaataaaccatgacatcttttcta

SEQ ID NO: 178530 - DNA, 2646 bp, Homo sapiens
  Payload ID: 15189
  Gene Symbol: RUFY1
  Gene Name: RUN and FYVE domain containing 1
  Uniprot ID: Q96T51
  ENST ID: ENST00000319449
  CDS Start-End: 13-2139
gacacggccaagatggccgaccgggaaggcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcactctggtgcgtgca

SEQ ID NO: 178531 - DNA, 2454 bp, Homo sapiens
  Payload ID: 15189
  Gene Symbol: RUFY1
  Gene Name: RUN and FYVE domain containing 1
  Uniprot ID: Q96T51
  ENST ID: ENST00000393438
  CDS Start-End: 159-1961
aaaaatggaaccggggttgcgggagaagccaaacgcggcgagtcttgctaaagccgtcgccgtagcaacgcgcggagccgtctgggagaggcctctggagcaggaggcccagtggctcttctgacccaaggccccgccgtccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttca

SEQ ID NO: 178532 - DNA, 2320 bp, Homo sapiens
  Payload ID: 15189
  Gene Symbol: RUFY1
  Gene Name: RUN and FYVE domain containing 1
  ENST ID: ENST00000393448
  CDS Start-End: 1-973
ggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagaggaagagagaatgaaaggacaggacaaaggagggctgagccgaggaagagagcttgctgccagctgcccggcagtctccttgctggacacatcttgtctcctgttagcaggaggggggtgctcagcccttctgaggctttccacagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtaagaaccccactccccttgtctgccactgcaggcacaccaggctacccaccacatccctcaggccccaaacctacctccttttggcgaacggagggtgggccatttaggagctcagtccgccgttcacggatgagctctcaggaagcccggcctcagaggggcccagcactgatctctgctacccacatggggtgtcagcgagctcttagttaattcaggaagcacgttcattcctagtgaccaggacactcctattccttagcttcatatccagggcctgagggaacagatgggcaatgagaggatcgcttggtcagcctacagtcaggccagagggagcagggctggtttgggaacggaagcctggcacagtagaggtgcactcacccgccttgcacagcacagcccccttcctttcggggaactggccactgcatccgccagagtctgtctgtctctgctgcaggtgctgatggggtgcagaccctggtagttctgctcccctctgacttgacagctctcctccttggtgtcccagtctagataggttgctgtggacgcctgggccttggggtggatcac

SEQ ID NO: 178533 - DNA, 2642 bp, Homo sapiens
  Payload ID: 15189
  Gene Symbol: RUFY1
  Gene Name: RUN and FYVE domain containing 1
  Uniprot ID: Q96T51
  ENST ID: ENST00000437570
  CDS Start-End: 348-2150
aaaaatggaaccggggttgcgggagaagccaaacgcggcgagtcttgctaaagccgtcgccgtagcaacgcgcggagccgtctgggagaggcctctggagcaggaggcccagtggctcttctgacccaaggccccgccgtccaggtagggggctgtggcctctagggatcagggactacttacctgcgaatcccggttgcccgcccgccagcacgtccgttccctaagcagaccgcctggcctcctgcctgacccgtcttctcaccgttgcccggagtctgacctccccacgctcagtccactaacgaagctatccctgctcctgccccacagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttc

SEQ ID NO: 178534 - DNA, 658 bp, Homo sapiens
  Payload ID: 15189
  Gene Symbol: RUFY1
  Gene Name: RUN and FYVE domain containing 1
  ENST ID: ENST00000502984
  CDS Start-End: 1-658
ggctgggcggcggggacagcggggacggcacggcgcgcgcagccggcgttttgctcgtcacccaggctggagtgcaatggcgtgatctcgggtcacggcaacctccgcctcccaggttcaagcgattctcctgcctcagcctcccaagcagctgggattacaagcatgcaccaccacgcccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttct

SEQ ID NO: 178535 - DNA, 984 bp, Homo sapiens
  Payload ID: 15189
  Gene Symbol: RUFY1
  Gene Name: RUN and FYVE domain containing 1
  ENST ID: ENST00000502434
  CDS Start-End: 1-984
gcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtg

SEQ ID NO: 178536 - DNA, 812 bp, Homo sapiens
  Payload ID: 15189
  Gene Symbol: RUFY1
  Gene Name: RUN and FYVE domain containing 1
  ENST ID: ENST00000508609
  CDS Start-End: 1-812
tagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggactgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaa

SEQ ID NO: 178537 - DNA, 2033 bp, Homo sapiens
  Payload ID: 15190
  Gene Symbol: RUFY2
  Gene Name: RUN and FYVE domain containing 2
  ENST ID: ENST00000265865
  CDS Start-End: 820-1410
ttttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatattgaaaaaaaaaaatcacaaaacaacttctagacattgtgtggctctttcacgtttgagtttgtgagttttcccccaaactttgttttcatttagaaatgtttctatttccccatttttcttttatttgtcttcttcacccttttacaccctagttctagcctcagttttacccaaagttgatttgaattacaccagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcatt

SEQ ID NO: 178538 - DNA, 983 bp, Homo sapiens
  Payload ID: 15190
  Gene Symbol: RUFY2
  Gene Name: RUN and FYVE domain containing 2
  ENST ID: ENST00000342616
  CDS Start-End: 89-787
agatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaagagatgaaagcttattattcacaagtttgcaaatactgg

SEQ ID NO: 178539 - DNA, 4502 bp, Homo sapiens
  Payload ID: 15190
  Gene Symbol: RUFY2
  Gene Name: RUN and FYVE domain containing 2
  Uniprot ID: Q8WXA3
  ENST ID: ENST00000388768
  CDS Start-End: 328-2253
atgggtaaggcgagcgggccgaaaccgaacgctaggccctcagtcccgggctgagggccgcggccaggcggggtggactgggagctgggggagacgccgaggccgccagtcggaactggggcccgaacccaggatgggcggggactgcctgggactcgggggctcccggggtcgtcatggcaacgcgccccctcccttgttccggcccgttcccgcccgggttctgaggcatagtggccgagggctcgaggtgccacggcgtccaggagcgaggacagggccaggcagggtgtcactcccgggtcggggagcaggcggggaggggcgatgacttttcaggtttgggggtggcggagggaagacgcatctcaggttttggcctgggtgcctgacgccgagggcgggagacggggaatgctgacgcgcaggagcctggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcattaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgactgacttgctttttttttttttttttttttttttaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaatt

SEQ ID NO: 178540 - DNA, 2685 bp, Homo sapiens
  Payload ID: 15190
  Gene Symbol: RUFY2
  Gene Name: RUN and FYVE domain containing 2
  Uniprot ID: Q8WXA3
  ENST ID: ENST00000399200
  CDS Start-End: 106-1317
gcagcgggcctggctgcagatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaatgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagtgacaacgatttgttaactcaaactaggacaattgcaatgtcattggtgaaatgtgccagcagtgacacgcaggaccagtacaagctggttaaagatatatctttctgaagaccacttgtatttaaacagactaaatgaaaagagaatcaacaattttataatatattaaatagaaaggaatctaaatgctattaaatattctaaaaggatgttaggaaccctgtacatttcttggtcagctgctgtggtaatacactgccatcaagcagagtgggtgcacttggatttccagacatacgttcctcaaaccttgtgcacaaagggtgatttgagtattgaccctttggaggtcaggattttcaaatgcagttttatctttttagctactttttgatgaaaaatataaagattgtttaaaaataacttaaccttcagttttatactgtgttggcacagatatttttttctcattggcccactctttgcccaatggctcccttacagatttttacatatgctttaaaataatttataacccagactggccaacaccctgtgcttcagcttctcagttttccggttctcccttgccctcttctgtgatagcacaacttcaaggcctacctcactctgacttctattttcctttttgtaaccttagagaaaagcttgggtccaatcccagcacctgaatattttaatttaaacttggatttggagataacttaaatgttactctcccttccttggaagcagcatttatacccctgaaatatgtgagggttgctccattggtatggttttaaggaagaaaggaagaggaagagttttttagttagttgaaccgaaatttctcttgtgatttcctgcaaggagttaatatcctttgaatcttggtaaatattttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagt

SEQ ID NO: 178541 - DNA, 2613 bp, Homo sapiens
  Payload ID: 15190
  Gene Symbol: RUFY2
  Gene Name: RUN and FYVE domain containing 2
  Uniprot ID: Q8WXA3
  ENST ID: ENST00000454950
  CDS Start-End: 106-1245
gcagcgggcctggctgcagatgcggtggtggccgccgagcgcctggaaggagctgctggacaggccgagggagcctccgcccgagaccgcgcagccgccgccgccatggtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagtgacaacgatttgttaactcaaactaggacaattgcaatgtcattggtgaaatgtgccagcagtgacacgcaggaccagtacaagctggttaaagatatatctttctgaagaccacttgtatttaaacagactaaatgaaaagagaatcaacaattttataatatattaaatagaaaggaatctaaatgctattaaatattctaaaaggatgttaggaaccctgtacatttcttggtcagctgctgtggtaatacactgccatcaagcagagtgggtgcacttggatttccagacatacgttcctcaaaccttgtgcacaaagggtgatttgagtattgaccctttggaggtcaggattttcaaatgcagttttatctttttagctactttttgatgaaaaatataaagattgtttaaaaataacttaaccttcagttttatactgtgttggcacagatatttttttctcattggcccactctttgcccaatggctcccttacagatttttacatatgctttaaaataatttataacccagactggccaacaccctgtgcttcagcttctcagttttccggttctcccttgccctcttctgtgatagcacaacttcaaggcctacctcactctgacttctattttcctttttgtaaccttagagaaaagcttgggtccaatcccagcacctgaatattttaatttaaacttggatttggagataacttaaatgttactctcccttccttggaagcagcatttatacccctgaaatatgtgagggttgctccattggtatggttttaaggaagaaaggaagaggaagagttttttagttagttgaaccgaaatttctcttgtgatttcctgcaaggagttaatatcctttgaatcttggtaaatattttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagt

SEQ ID NO: 178542 - DNA, 2110 bp, Homo sapiens
  Payload ID: 15190
  Gene Symbol: RUFY2
  Gene Name: RUN and FYVE domain containing 2
  ENST ID: ENST00000466493
  CDS Start-End: 1-1862
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttg

SEQ ID NO: 178543 - DNA, 3863 bp, Homo sapiens
  Payload ID: 15190
  Gene Symbol: RUFY2
  Gene Name: RUN and FYVE domain containing 2
  Uniprot ID: Q8WXA3
  ENST ID: ENST00000602465
  CDS Start-End: 102-1922
cgggcctggctgcagatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcattaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgactgacttgcttttttt

SEQ ID NO: 178544 - DNA, 405 bp, Homo sapiens
  Payload ID: 15190
  Gene Symbol: RUFY2
  Gene Name: RUN and FYVE domain containing 2
  ENST ID: ENST00000463210
  CDS Start-End: 1-392
tatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagacatggcagctactgcatcttcatgtgtcacaaactctacatctgcttctcctgtggctctgccatcagctccaatatcaatatgaactcgtattggatttagtggtgagaagaactaaataaaaggaaacactta

SEQ ID NO: 178545 - DNA, 4233 bp, Homo sapiens
  Payload ID: 15191
  Gene Symbol: RUFY3
  Gene Name: RUN and FYVE domain containing 3
  Uniprot ID: Q7L099
  ENST ID: ENST00000226328
  CDS Start-End: 564-1973
gccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccgttttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaataggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatca

SEQ ID NO: 178546 - DNA, 3098 bp, Homo sapiens
  Payload ID: 15191
  Gene Symbol: RUFY3
  Gene Name: RUN and FYVE domain containing 3
  Uniprot ID: Q7L099
  ENST ID: ENST00000381006
  CDS Start-End: 580-2442
ctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaa

SEQ ID NO: 178547 - DNA, 2143 bp, Homo sapiens
  Payload ID: 15191
  Gene Symbol: RUFY3
  Gene Name: RUN and FYVE domain containing 3
  Uniprot ID: Q7L099
  ENST ID: ENST00000417478
  CDS Start-End: 137-1657
gtggccgagaagaaaggtggcggtggcggcggcggcgcagcggacgggacggggcggcggctcctcgccctgaccctctgctcccccgcccaggcccgggcgcgaatcggaggctgcggcgaaggaaggagtgagcatggctgagaccccgccgccgcccaccgctggtgccgaaagttgcagcgaggagccggcgaggggcggggagtggcggccggaggagccgcgccgcgctcccgccgggggcacggaccgagagggcgaggcggggccgccgccggcctcccccgccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccgctgcccttcctgctgctgagctacccgagcggcggcggcggcagcagcggcagcggcaagcaccatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaaggtaaaagtcctgtttctttaatgaaacactttggattgtcagtgctgaagtgaaaagaatgtgctgtacattcggcaaatagaaaatacatgaaattcttccaaattagcatcagacattctggtagaaaaaagccagttgaatgttatgtgtgttttctaaggtatgactgaaatgtttttaggaaatgtcaatcacttgactagcctttaaaaaaaaaaaagaaaggtcagccttttatgactgttttgaacatcagaactcttaatccatgtcagagtcatgtgttagaggaaggatacttaaaagcatggaaggactcttaaatgtatgtatgtaattctgtgattttattgttcatcactgaagtctttgaatacttggatgctaggggatatagaggcactgagagataggtgtcctccaaggatctattctggatctttctctcccttctttaacccttttctcttatctcccttttctttct

SEQ ID NO: 178548 - DNA, 582 bp, Homo sapiens
  Payload ID: 15191
  Gene Symbol: RUFY3
  Gene Name: RUN and FYVE domain containing 3
  ENST ID: ENST00000512103
  CDS Start-End: 1-173
gagctctcaagcatgaacttgcctttaagctgcagagttcagacttaggagtaaaacagaaaagtgaactaaacagtcgcttggaagagaagactaatcagatggctgctaccattaaacaacttgaacaaaggatgggaagcacaaaatgcaagaggaaaatgttaaactaaaaaagcccctggaagaaagccacaggctgcaaccccaccctatggatgaacagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttga

SEQ ID NO: 178549 - DNA, 562 bp, Homo sapiens
  Payload ID: 15191
  Gene Symbol: RUFY3
  Gene Name: RUN and FYVE domain containing 3
  ENST ID: ENST00000504805
  CDS Start-End: 1-437
cacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaa

SEQ ID NO: 178550 - DNA, 2342 bp, Homo sapiens
  Payload ID: 15191
  Gene Symbol: RUFY3
  Gene Name: RUN and FYVE domain containing 3
  Uniprot ID: Q7L099
  ENST ID: ENST00000502653
  CDS Start-End: 196-1899
gattatgtgttcagaaggcagtctcagtgaacttctcaaagtgagaaggttgtagcttttaatacagtctcagaagcctatgggacaaagttttctggacacggttcatcccttcttgttgctctgccctgaaaataacctggctagtcaccctttcaagactcttgggaggatttgacagatttggtggagcaaatgcgcgatgatacagaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttc

SEQ ID NO: 178551 - DNA, 867 bp, Homo sapiens
  Payload ID: 15191
  Gene Symbol: RUFY3
  Gene Name: RUN and FYVE domain containing 3
  ENST ID: ENST00000513597
  CDS Start-End: 263-867
gtaattggcccttggtgagattacagaaacatttgttgccaccagtgcagtcagccttagatttacactgtcaggttctctgagctgtgattatgtgttcagaaggcagtctcagtgaacttctcaaagtgagaaggttgtagcttttaatacagtctcagaagcctatgggacaaagttttctggacacggttcatcccttcttgttgctctgccctgaaaataacctggctagtcaccctttcaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaacta

SEQ ID NO: 178552 - DNA, 482 bp, Homo sapiens
  Payload ID: 15191
  Gene Symbol: RUFY3
  Gene Name: RUN and FYVE domain containing 3
  ENST ID: ENST00000514898
  CDS Start-End: 189-482
aaatacaggatttcagtacagcgcacaagacgggaacaaaagaggtggtggaaggaagacacccacctttggtttctcacataaagagctcaatactccaaacagtgaatcaacggttgaagttgcagtgtgtgaaaggcaaatggcccgggcgcgaatcggaggctgcggcgaaggaaggagtgagcatggctgagaccccgccgccgcccaccgctggtgccgaaagttgcagcgaggagccggcgaggggcggggagtggcggccggaggagccgcgccgcgctcccgccgggggcacggaccgagagggcgaggcggggccgccgccggcctcccccgccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccg

SEQ ID NO: 178553 - DNA, 531 bp, Homo sapiens
  Payload ID: 15191
  Gene Symbol: RUFY3
  Gene Name: RUN and FYVE domain containing 3
  ENST ID: ENST00000503876
  CDS Start-End: 67-531
gtgccttcgtgctaccgataaagttggcggttacacgacaaaacgccgccagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgat

SEQ ID NO: 178554 - DNA, 2352 bp, Homo sapiens
  Payload ID: 15192
  Gene Symbol: RUFY4
  Gene Name: RUN and FYVE domain containing 4
  Uniprot ID: Q6ZNE9
  ENST ID: ENST00000344321
  CDS Start-End: 111-1826
gtaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagttgaagacccctctggggaaaggccgtgccttcatccgcttctgcctggcccgtgggcagctggctgaggccctgcagctttgcctcctgaactcagagctcaccagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgt

SEQ ID NO: 178555 - DNA, 2977 bp, Homo sapiens
  Payload ID: 15192
  Gene Symbol: RUFY4
  Gene Name: RUN and FYVE domain containing 4
  ENST ID: ENST00000374155
  CDS Start-End: 411-2234
aaatcctgggactgctgtgcaaggcagagtcactagggacggactctggcagcagagctgcgctctcgtgccccagccagccaggctctcctgggtgagtagcagggagacccctggaacttacggggatagaaggagtgtgatgccaggagccaggggaggaaaatgcctggcagagacgagggagaggaggagacacatggagccgttcatggatttcacacaggatctgggctggaaggggctgccgagaccatcagtccaatctttggtctacaggttgggaaactgaggctcaaggaaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagttgaagacccctctggggaaaggccgtgccttcatccgcttctgcctggcccgtgggcagctggctgaggccctgcagctttgcctcctgaactcagagctcaccagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaaggtgcctctgccctgccttcactctgagttgcctcttccccatctccttggcatcctcaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcagtgctaggaccagccttgggagagaggaaagtgagccaccaggagaagctgccatgtggaggtggaggctctggaggggtcgggcatcaggacacccttcaggagaggggagacctcctgagacaaaccaagggcattccactgggagatgagaaacagatgtctcaggtggacctgaagatgctggaactccatgacctcagcgcccacttggggaagtgccagctgcagaggccgccccaggctttcctgcctctgccttccaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgt

SEQ ID NO: 178556 - DNA, 3568 bp, Homo sapiens
  Payload ID: 15192
  Gene Symbol: RUFY4
  Gene Name: RUN and FYVE domain containing 4
  Uniprot ID: Q6ZNE9
  ENST ID: ENST00000457754
  CDS Start-End: 1433-1951
accacaatggatcagcccccatttggccaacaggtgactctaccccaggtgggcctgagaggacccatcccccatctcaccattctgccccagcgccctggatcctgcctctaccacttcttccctgcgcagtcactagggacggactctggcagcagagccgcgctgtcgtgccccagccagccaggctctcctgggatctgggctggaaggggctgccgagaccatcagtccaatctttggtctacaggtggggaaactgaggctcaaggaaggtcagtggggggccagaagggacctcatgtgtgagatctggaagcgggaattggagcagcagtttcattctgcttcagctcaggaagcccctgcagcagcccagcctggagaaacgaggacccagcatggaaagaccccagcctcaaggaggcagagcacagccaggaagggaagccccagcccacctgggaaacccacctggcccattgctgggcacaggatctcactggtggtctcacatccatccttttgggaatgagatcaggactagggattcggcactggtgaccagcactcaggtggaccgctcagctgactgaggtggagaaggaaggaggagcgtggtgggaccctcgccctgccctccccactctggagcgctgcctctcagcccaaccaagtgacagagacgagacaaccacaggaatagcagctgcggagctccatggcctccctctgccccctggtggtgagaaggagaaaagcaagagcaggtgctgaaaacgaaaaggaaactagcagcagtcccagctaccacaatggatcagcccccatttggccaacaggtgactctaccccaggtgggcctgagaggacccatcccccatctcaccattctgccccagcgccctggatcctgcctctaccacttcttccctgcagcgtctgcggttcccccaccgctgtgagccaggttccccctccaggctgctgggctgggactgagttacttcttcccaggctgtaaatcctgggactgctgtgcaaggcagagtcactagggacggactctggcagcagagctgcgctctcgtgccccagccagccaggctctcctgggtgagtagcagggagacccctggaacttacggggatagaaggagtgtgatgccaggagccaggggaggaaaatgcctggcagagacgagggagaggaggagacacatggagccgttcatggatttcacacaggatctgggctggaaggggctgccgagaccatcagtccaatctttggtctacaggttgggaaactgaggctcaaggaaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagagctgccgtctctgccatcctccagggctatggggatgggcaggggccagtgacggacaccagtgccgagctgcacagactctgtggctgcctggagctgctgctgcagtttgaccagaaagagcagaagagcttcctggggcctcggaaggattactgggactttctctgcactgccctacgacggcagcggggaaacatggagccaatccactttgtccgttcccaggacaagggaatggtatggaccccggagccctctgctctgcccagaacgccaagaagacatcctggactctctctatgctctcaatggggtggccttcgagttggacctccagcagccagacctggatggagcctggcccatgttctcagagtcacgctgctccagttccacccaaacccagggaaggagacccagaaaaaacaaagatgccccaaagaagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaagagcctcagacttgggctccggaaggctgaggagcaggcccagcgccaggagcagctgctgagggagcaggagggggagctgcaggcacttcgggagcagctcagcaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccaagagaaggaccgcctgtggcagaggctccagcatctctcttccatggctcccgagtgctgtgtggcctgtagcaagatctttggccgattttctcggcggtatccatgcaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgta

SEQ ID NO: 178557 - DNA, 2163 bp, Homo sapiens
  Payload ID: 15193
  Gene Symbol: RUSC1
  Gene Name: RUN and SH3 domain containing 1
  Uniprot ID: Q9BVN2
  ENST ID: ENST00000292254
  CDS Start-End: 319-1620
ggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 178558 - DNA, 2503 bp, Homo sapiens
  Payload ID: 15193
  Gene Symbol: RUSC1
  Gene Name: RUN and SH3 domain containing 1
  Uniprot ID: Q9BVN2
  ENST ID: ENST00000368347
  CDS Start-End: 482-1960
gccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctacacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 178559 - DNA, 1968 bp, Homo sapiens
  Payload ID: 15193
  Gene Symbol: RUSC1
  Gene Name: RUN and SH3 domain containing 1
  Uniprot ID: Q9BVN2
  ENST ID: ENST00000368349
  CDS Start-End: 126-1427
cgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttg

SEQ ID NO: 178560 - DNA, 3403 bp, Homo sapiens
  Payload ID: 15193
  Gene Symbol: RUSC1
  Gene Name: RUN and SH3 domain containing 1
  Uniprot ID: Q9BVN2
  ENST ID: ENST00000368352
  CDS Start-End: 152-2860
cgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 178561 - DNA, 3114 bp, Homo sapiens
  Payload ID: 15193
  Gene Symbol: RUSC1
  Gene Name: RUN and SH3 domain containing 1
  Uniprot ID: Q9BVN2
  ENST ID: ENST00000368354
  CDS Start-End: 183-2573
gctagtgcccctcccctcccgctctgtgccccgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttg

SEQ ID NO: 178562 - DNA, 934 bp, Homo sapiens
  Payload ID: 15193
  Gene Symbol: RUSC1
  Gene Name: RUN and SH3 domain containing 1
  ENST ID: ENST00000489860
  CDS Start-End: 138-934
cgggatgaagagggcaccctccgccaagaggctgctgcgggacccgggtttcccctttccggcgccttccagcctcccaatcctcggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgaccca

SEQ ID NO: 178563 - DNA, 1156 bp, Homo sapiens
  Payload ID: 15193
  Gene Symbol: RUSC1
  Gene Name: RUN and SH3 domain containing 1
  ENST ID: ENST00000497930
  CDS Start-End: 254-1156
ccggcgccgggctgcggctgctgggggcgccgagccccccagaggagcagctgctgcccgtccgcctgtccccggtgggagcctattcgcctccgactcggggagccttgccctgcctggccagccccgagctggcactgctgctgtccccgctctttcccagaagtagcaccttccccgccgcggctcccccaccccgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagaccc

SEQ ID NO: 178564 - DNA, 930 bp, Homo sapiens
  Payload ID: 15193
  Gene Symbol: RUSC1
  Gene Name: RUN and SH3 domain containing 1
  ENST ID: ENST00000479924
  CDS Start-End: 116-930
gccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatag

SEQ ID NO: 178565 - DNA, 676 bp, Homo sapiens
  Payload ID: 15193
  Gene Symbol: RUSC1
  Gene Name: RUN and SH3 domain containing 1
  ENST ID: ENST00000485924
  CDS Start-End: 1-676
gctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccag

SEQ ID NO: 178566 - DNA, 682 bp, Homo sapiens
  Payload ID: 15193
  Gene Symbol: RUSC1
  Gene Name: RUN and SH3 domain containing 1
  ENST ID: ENST00000468764
  CDS Start-End: 112-429
tagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacct

SEQ ID NO: 178567 - DNA, 1749 bp, Homo sapiens
  Payload ID: 15193
  Gene Symbol: RUSC1
  Gene Name: RUN and SH3 domain containing 1
  ENST ID: ENST00000471876
  CDS Start-End: 823-1206
cgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 178568 - DNA, 1700 bp, Homo sapiens
  Payload ID: 15193
  Gene Symbol: RUSC1
  Gene Name: RUN and SH3 domain containing 1
  ENST ID: ENST00000490373
  CDS Start-End: 906-1541
ggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctccta

SEQ ID NO: 178569 - DNA, 5199 bp, Homo sapiens
  Payload ID: 15194
  Gene Symbol: RUSC2
  Gene Name: RUN and SH3 domain containing 2
  Uniprot ID: Q8N2Y8
  ENST ID: ENST00000361226
  CDS Start-End: 139-4689
gccgccgccgccggcgcggaaggacgaggctgaggcgagaaacgaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctcc

SEQ ID NO: 178570 - DNA, 5636 bp, Homo sapiens
  Payload ID: 15194
  Gene Symbol: RUSC2
  Gene Name: RUN and SH3 domain containing 2
  Uniprot ID: Q8N2Y8
  ENST ID: ENST00000455600
  CDS Start-End: 570-5120
atcttccctgagatgcctaaggacaaaagaggagctagacacaactctccccatttttcctttgctgtcttaagagtgctccatcttccagcactgactgccctctgtggctggctcctttctctaccctcccccttccctaggctaaagggcccacaggggctggaagggagggaggctgagtggctgtgctgtgggcctgcctgctcctttcccttcccccttcccttagcagcaacgtcaccgcagcaccagcagccgcggcagcagcacggagactggggctgggattgcgcagcctccctgcattagcaacgatgccattgtattagcagaaatcagatcttaggaaatcggcccagttcccctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaacca

SEQ ID NO: 178571 - DNA, 6955 bp, Homo sapiens
  Payload ID: 15195
  Gene Symbol: RUBCN
  Gene Name: RUN domain and cysteine-rich domain containing, Beclin 1-interacting protein
  Uniprot ID: Q92622
  ENST ID: ENST00000273582
  CDS Start-End: 547-3330
gagcagttcgactttccgcccaaactgggggatgctagaccgcgggcacctctgaatcttatgccttcagtgatataatcctccgtgtccttcgagtccctcctgctgcagacaggtcccctatacttcggtacacacgagcctttcgcgcccaccgcaacgcagcctcgggaggcaggacagacccctgcgagtgtagattgcagctgcatcccagctcccccctccctggcacgctcctccacctacagctgcgctgagctgccgcatctgaacgcaaagcaaacgctgcagtgacggttcctgcgtcaccttaactccaaagtaaatgctaacgtttcccgtgtctgtaccttctctcaatcggcactctcaaaacatctggcacggtgttcactaccctaataagacctcagcttccctcgggaggggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggaggccccaggaatatcaccattatagttgaagatcccattgcagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttctttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtcagcctgccttgactgtcaagaaatggcatgtgtccactgtaaagcaggtatatctgaacattgagaaggtttctgtgttataatgtaaagcaaactggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccagtgtgtctaaaaccagcataaattccgtatttccaaaaacctaaccattagtcacccaggtttgaaaattaattgtcttcaacttcctctgtaagtggcacactgagctcatcacgcatcgtctcattcctactccctgtcatcaagttctgtggatgttttcctctaaaataaatctctcattacttttctgccactagcacacaaa

SEQ ID NO: 178572 - DNA, 2919 bp, Homo sapiens
  Payload ID: 15195
  Gene Symbol: RUBCN
  Gene Name: RUN domain and cysteine-rich domain containing, Beclin 1-interacting protein
  Uniprot ID: Q92622
  ENST ID: ENST00000296343
  CDS Start-End: 1-2919
atgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctga

SEQ ID NO: 178573 - DNA, 1603 bp, Homo sapiens
  Payload ID: 15195
  Gene Symbol: RUBCN
  Gene Name: RUN domain and cysteine-rich domain containing, Beclin 1-interacting protein
  ENST ID: ENST00000449205
  CDS Start-End: 190-1497
gggggtggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggtaatgaggaacaccggctgctagttagcaagatgaccctgaattgagagtaagagagggcttgttatggggacttttcaggtggcagaaagagatgttctgtttctggtgatacaacatcttattttgtaatgaaagaagtttataacgaaa

SEQ ID NO: 178574 - DNA, 3801 bp, Homo sapiens
  Payload ID: 15195
  Gene Symbol: RUBCN
  Gene Name: RUN domain and cysteine-rich domain containing, Beclin 1-interacting protein
  ENST ID: ENST00000413360
  CDS Start-End: 1-2803
gagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggaggccccaggaatatcaccattatagttgaagatcccattgcagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttctttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagta

SEQ ID NO: 178575 - DNA, 2665 bp, Homo sapiens
  Payload ID: 15195
  Gene Symbol: RUBCN
  Gene Name: RUN domain and cysteine-rich domain containing, Beclin 1-interacting protein
  ENST ID: ENST00000415452
  CDS Start-End: 1-2042
cagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatggtagcgaaggatctaacctgactcacatatcaaagaacggactgtcagtgtcactggcctcgatgttctcagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatggtgagaaagtctcactgtagcatgcagctgagcccttgcttttagggatacagggaggggggtggacctggggttcttgccacttagcttgaggaagttgaaatggccagtcagcactgggagaggaactggaaagggctgctgttccttagcctggagagcagccaaatcatcctgatctaaagaacctcgagtgaggggaggagctggtgctggctgtggtcctgggtagctccgggcaagaccgagtagactttcactcaagaagtgttggccaggcacggtggcttaggcctctcatcccagcaatttgggaggccgaggtgggcgggtcacctgaggtcaggagttcaagaccagcctgacgaacatgatgaaaccccatctctactaaaatacagaaattagccgggcatgatggcgggtgcctgtaatcccagctactcgggaggctgaggcaggagaattgcttgaatccaggaggcggaggttgcagtgagccgagatcatgccactgcactccagcctgagcgacaagagtggaaaaaaaaaaggcagttgtcatgatgtgagaggagagctctggattggaatcgagagggagtctaccctcggccgtcatttgttgttctcagtcattatgaccaaaataaatactttgtcccctc

SEQ ID NO: 178576 - DNA, 442 bp, Homo sapiens
  Payload ID: 15195
  Gene Symbol: RUBCN
  Gene Name: RUN domain and cysteine-rich domain containing, Beclin 1-interacting protein
  ENST ID: ENST00000447048
  CDS Start-End: 1-442
ttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgca

SEQ ID NO: 178577 - DNA, 615 bp, Homo sapiens
  Payload ID: 15195
  Gene Symbol: RUBCN
  Gene Name: RUN domain and cysteine-rich domain containing, Beclin 1-interacting protein
  ENST ID: ENST00000474214
  CDS Start-End: 542-615
gaagtgggggtggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgc

SEQ ID NO: 178578 - DNA, 3828 bp, Homo sapiens
  Payload ID: 15196
  Gene Symbol: RUNDC1
  Gene Name: RUN domain containing 1
  Uniprot ID: Q96C34
  ENST ID: ENST00000361677
  CDS Start-End: 13-1854
gtttccgggaagatggcggctgtcgaagcggctgcagagccggtaacggtggtggcggctgttgggccaaaggcgaaagacgaagaggaggaggaagaggagccgctgccaccgtgcgaggcggtgcgctgggccccagtgggggcggtggcggaggcccggcctggggcaaccgcgtttttagaagaggcgacggccgaggagcctggcgcggccccgggctccccgccggattcgccgggccggacgctgcggcggctgcgggcagagcggcggcggctggactcggcgctgctggcgctgtcctcgcacttcgcgcaggtgcagttccgcctgcgccaggtggtgcgcggggcgccggcggagcagcagcgccttctgcgggagctcgaagacttcgccttccgcggctgccctcacgtcctaggttacgaagggcccggcgaccccgccagcgatgagggcgatgggctgccaggggaccggccatggttgcggggcgaggaccagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacacggtgaaaccccatctctactaaaaatacaaaaaaattagtcggacatggtggcaggcacctgtagtcccagctactcgggaggctgaggcaggagaatggcgtgaacccaggaggcggagcttgcagtgagccaagatcgcgccactgcactccagcctgggcgacagagtgagactccgtctcaaaaaaaaaaagaaggttgtacccacagtatacgtgtgggcacttgtgcttgagcctgtattaaaggaatcaggccaggcacagtggctcacgcctgtaatctcagcacattgggaggctgaggtgggcggatcacctgaggtcaggagttcaagaccagcctggccaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccattgcactccagcctgggcaacacagggagactccatctcaaaaaaaaaaaaaaaaaaaaaaagacattcaacttgaggctcctgttagttaagctatcttctttcacttgaagcaggtttgagaggcctaggccagaatttaaattccttttatgaatagatttccctttcttcctgaccccaaggtcagaggagactatatattccatggctgcctctaagactaggaataggaatatctgaaaacagcatttctaagggtggtaaccacaggtcgattttaatacgagtcctttttcttgtagaggtaagtaaaatcttcctgacaaggtagtcctcttttcatggcacagacaatgggctttctgtttatgaggggtgagaagtgatgtttgttactatgttctccagcaagtaaacattcctctgctcacctcccaacaagactaacagtctttttagaagtaaatatattcaagacaaacgagaaaatcctggctacccaagtcgagtatatacaggaatacaaatcggtaaccagcagctgttcctcaggttgtgactcactgagcaccacttgtcctggaggctggatgatggaggacatctggttataggtactgtagcagggataggtgccacaggaggataggaactacagcagatcgctgtttccagaacggggaggagtatctcattgtgaaacagactctagagtggttctatttggtcttcagtgttttagcctcgttagttcatatttggcatgcagcttgtggtgagtactgttctaggactggccaaaaatgggcaaaatgtatcactccaaacactactgattcagcattgttttcatgtcttaaaattgccacctgcactttgtttctgcactattatgtagtgcattttaacttaaattttttccagcaacatgttacttatttaagatacattactgatatttcattataattagttcaccttccctgtgaaacaagagaattgtaaaatgttgtggaaaatgatacatatgtggatgctaatgaaatcatagtattttgtgtagcttctctgaagaccttagagatctgcagctttggtttataagtgtttgggccttatcagcccatctgatccagatcaatatttttttgaaaactg

SEQ ID NO: 178579 - DNA, 959 bp, Homo sapiens
  Payload ID: 15196
  Gene Symbol: RUNDC1
  Gene Name: RUN domain containing 1
  ENST ID: ENST00000589705
  CDS Start-End: 1-791
cggctgtcgaagcggctgcagagccggtaacggtggtggcggctgttgggccaaaggcgaaagacgaagaggaggaggaagaggagccgctgccaccgtgcgaggcggtgcgctgggccccagtgggggcggtggcggaggcccggcctggggcaaccgcgtttttagaagaggcgacggccgaggagcctggcgcggccccgggctccccgccggattcgccgggccggacgctgcggcggctgcgggcagagcggcggcggctggactcggcgctgctggcgctgtcctcgcacttcgcgcaggtgcagttccgcctgcgccaggtggtgcgcggggcgccggcggagcagcagcgccttctgcgggagctcgaagacttcgccttccgcggctgccctcacgtcctaggttacgaagggcccggcgaccccgccagcgatgagggcgatgggctgccaggggaccggccatggttgcggggcgaggaccagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcggatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgt

SEQ ID NO: 178580 - DNA, 1821 bp, Homo sapiens
  Payload ID: 15197
  Gene Symbol: RUNDC3A
  Gene Name: RUN domain containing 3A
  Uniprot ID: Q59EK9
  ENST ID: ENST00000225441
  CDS Start-End: 238-1455
acggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctca

SEQ ID NO: 178581 - DNA, 2048 bp, Homo sapiens
  Payload ID: 15197
  Gene Symbol: RUNDC3A
  Gene Name: RUN domain containing 3A
  Uniprot ID: Q59EK9
  ENST ID: ENST00000426726
  CDS Start-End: 275-1615
actggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgag

SEQ ID NO: 178582 - DNA, 1675 bp, Homo sapiens
  Payload ID: 15197
  Gene Symbol: RUNDC3A
  Gene Name: RUN domain containing 3A
  Uniprot ID: Q59EK9
  ENST ID: ENST00000590941
  CDS Start-End: 251-1453
ggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtc

SEQ ID NO: 178583 - DNA, 1212 bp, Homo sapiens
  Payload ID: 15197
  Gene Symbol: RUNDC3A
  Gene Name: RUN domain containing 3A
  ENST ID: ENST00000612735
  CDS Start-End: 1-1212
atggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggtagctcccccaac

SEQ ID NO: 178584 - DNA, 4099 bp, Homo sapiens
  Payload ID: 15198
  Gene Symbol: RUNDC3B
  Gene Name: RUN domain containing 3B
  Uniprot ID: Q96NL0
  ENST ID: ENST00000338056
  CDS Start-End: 412-1833
gctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaagagatttcccaaagttgcagatggctggctcatctccaaatacctcttcaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttgtttttaataacgggaaagttctcagctgcattttcacagtggcttattcagtttttctttaatatttaccatttggtatcaattcagcattccacttaacattttataaattccataggaacatgcctgttttggtagttactgacttaatttgttagtgccacaaggaaaatattttacagtattttatgccatttaggcaaaatgaataaactgttttccaagattttcttaaaagattatcaatttaaaagtatgatcaagtatgcctcaaaaactagaaacatttcaaaatgtagaacaaacgttgaaaaattgttttgccaggaaagagttcaagttcagttaaggatttgagaggcttttaaacaaggatcagtaggatagttatcatatttacttaatatatgtctgatattcagtgctggttctttttcctgtttgtgcaacaatgaagtgtgtcatgtgtgttttatagcctctatcattaatcacaccagagtctcattttaaaacattttaatgttaaaacatccccacacttatacacaggtaaaattagtttttttttttttaaagttgtaatctgtacttttttttttttgcaatttttgaaacagctacattaatccctaaaaatcccaccatactgaaaatgtatggcgtgtattttctatagtaagtaatatgaggaaaacatgattagctgtgccaaagaaattttatacattgtttacatgatgaggccacagtacttactgaggacttcatatggtttttttgtttattattattgagaaaagagctgaggttaccacattcattctttgtgttagaaatgtaggagtgtggtggttttctgcaatatttagagcttagtctcataatttggaatttaagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatg

SEQ ID NO: 178585 - DNA, 2064 bp, Homo sapiens
  Payload ID: 15198
  Gene Symbol: RUNDC3B
  Gene Name: RUN domain containing 3B
  Uniprot ID: Q96NL0
  ENST ID: ENST00000394654
  CDS Start-End: 210-1580
gtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttg

SEQ ID NO: 178586 - DNA, 2020 bp, Homo sapiens
  Payload ID: 15198
  Gene Symbol: RUNDC3B
  Gene Name: RUN domain containing 3B
  Uniprot ID: Q96NL0
  ENST ID: ENST00000493037
  CDS Start-End: 371-1594
gaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaa

SEQ ID NO: 178587 - DNA, 6222 bp, Homo sapiens
  Payload ID: 15199
  Gene Symbol: RUNX1
  Gene Name: runt-related transcription factor 1
  Uniprot ID: Q01196
  ENST ID: ENST00000300305
  CDS Start-End: 446-1888
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 178588 - DNA, 7274 bp, Homo sapiens
  Payload ID: 15199
  Gene Symbol: RUNX1
  Gene Name: runt-related transcription factor 1
  Uniprot ID: Q01196
  ENST ID: ENST00000344691
  CDS Start-End: 1579-2940
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 178589 - DNA, 2720 bp, Homo sapiens
  Payload ID: 15199
  Gene Symbol: RUNX1
  Gene Name: runt-related transcription factor 1
  Uniprot ID: Q01196
  ENST ID: ENST00000358356
  CDS Start-End: 1579-2331
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcacta

SEQ ID NO: 178590 - DNA, 822 bp, Homo sapiens
  Payload ID: 15199
  Gene Symbol: RUNX1
  Gene Name: runt-related transcription factor 1
  ENST ID: ENST00000399237
  CDS Start-End: 54-822
ggagttggcagcgcacgccggaccgggggcggggccctccgagctccgcgaaaatgcccgcagcaccgcggggaccggcgcagggggaagcggccgcccgcacgcgaagccgggatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcagg

SEQ ID NO: 178591 - DNA, 1590 bp, Homo sapiens
  Payload ID: 15199
  Gene Symbol: RUNX1
  Gene Name: runt-related transcription factor 1
  ENST ID: ENST00000399240
  CDS Start-End: 72-1241
tgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgct

SEQ ID NO: 178592 - DNA, 610 bp, Homo sapiens
  Payload ID: 15199
  Gene Symbol: RUNX1
  Gene Name: runt-related transcription factor 1
  ENST ID: ENST00000455571
  CDS Start-End: 191-610
ctttgggcctcataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaac

SEQ ID NO: 178593 - DNA, 346 bp, Homo sapiens
  Payload ID: 15199
  Gene Symbol: RUNX1
  Gene Name: runt-related transcription factor 1
  ENST ID: ENST00000416754
  CDS Start-End: 250-346
cacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacg

SEQ ID NO: 178594 - DNA, 5967 bp, Homo sapiens
  Payload ID: 15199
  Gene Symbol: RUNX1
  Gene Name: runt-related transcription factor 1
  Uniprot ID: Q01196
  ENST ID: ENST00000437180
  CDS Start-End: 191-1633
ctttgggcctcataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 178595 - DNA, 1710 bp, Homo sapiens
  Payload ID: 15199
  Gene Symbol: RUNX1
  Gene Name: runt-related transcription factor 1
  ENST ID: ENST00000482318
  CDS Start-End: 181-297
cataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttga

SEQ ID NO: 178596 - DNA, 1582 bp, Homo sapiens
  Payload ID: 15199
  Gene Symbol: RUNX1
  Gene Name: runt-related transcription factor 1
  ENST ID: ENST00000475045
  CDS Start-End: 1435-1582
aaactgctgcccttctagtgctgatgctggactgaagcttcctgcaggctgggatcctgtctgcatatctcgcaatgtgttcccaggaccaggcgtagtttctgaactgtgaagccaactatgcagcgatgactgtacccacagatgttaatgattaagaacaagtgcgacagagatcaacagctctgcgttcaagtccaaactcttcccctcggcaaggcacgtgacctccctgtgcctcaggttcttgcagagtggaaatgcccacttcacagaatggctgagggtgtggatgaacggtggacgctcctgcccggcacccatgggtgctcacgacgattgtgttttactgttggctgcaatatgtcatgacttatcatgtgtgatccttgagtgaataggcagctgcgagcctgagcggactcctatgaaccagtcttctccagcaatagaccctccttcaactcgtggtagcctgtacgccaagggtgacagactggaaagcaggatccaccggttcatctatgggaaaaggagggggaatgagatcaaggattgaggacgctaatggagatggggtttcaccatgttgcccaggctggtcttgaactcctagactcaagtgatccactcgccttggcctcccaaaatgctggaattacagtttatgtattgaagaacctgggccgtttgacccacggagtggttctcaatctggatttggctgattgggcactcatgttgcaggttaacatgctcctcggttttctgacctcctagaagttggcagctggatccagaagcttcaacagcctcaggttcagcctcctgggctggcggattgtaggccaaagcttgatttgggtatcagcaagttaaaactcaggcacatccatctttcctgatccaagtaaattctagtgggcaagaggaagagaagagaaactacaacatcattatcttactgctggaggcagcagattacggacccctgactgtgatgtgtcaaatgcactgtgtgacaaccaagaccctacacatctggggggcacttcaggattcctccaggcggcagttgctggcctagactcacttcttcaggagggaggttcgccctggaaaagctgatttgcatttctgctgggatcgatgccgtggagactgaatacattgaggtctccaggtgaaagaagaaagcttaacctggcttctgaattccaagagcacacggcaaagtgagcgagcccggcacccagctgtcgtccacttgcatttagtgtagctgccacccagcaattaacgcgcctgggctctcctttggaaaccgagcagagaagaacaataccacagcgagttcgcctggacccgaaagcaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccag

SEQ ID NO: 178597 - DNA, 7284 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000265814
  CDS Start-End: 195-2009
tatgcaggcaacatagcccttcatagcaaagcagtctgaaaaattggcacctgcaggatttgcatgtgaaaaaaacggagtcagttgcattttgccggagtctattactaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178598 - DNA, 2370 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000360348
  CDS Start-End: 212-1915
caggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaa

SEQ ID NO: 178599 - DNA, 3463 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000396218
  CDS Start-End: 412-2145
tgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 178600 - DNA, 2450 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000422361
  CDS Start-End: 298-2001
tataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaaga

SEQ ID NO: 178601 - DNA, 7454 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000436581
  CDS Start-End: 188-2179
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178602 - DNA, 585 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521054
  CDS Start-End: 72-585
aacataagtgggaagctatttattcccttgttgctgaggttggttgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgccc

SEQ ID NO: 178603 - DNA, 574 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000520556
  CDS Start-End: 300-574
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 178604 - DNA, 553 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518449
  CDS Start-End: 380-553
ctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaaca

SEQ ID NO: 178605 - DNA, 556 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518823
  CDS Start-End: 319-556
aatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcct

SEQ ID NO: 178606 - DNA, 7537 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000523629
  CDS Start-End: 456-2270
atcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcc

SEQ ID NO: 178607 - DNA, 2103 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000520724
  CDS Start-End: 145-1992
ttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaatt

SEQ ID NO: 178608 - DNA, 565 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000524215
  CDS Start-End: 143-349
ttttatttgcagctcggagcctgtggcggatggtgggactctccggccctgtgcagtaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagcct

SEQ ID NO: 178609 - DNA, 574 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518317
  CDS Start-End: 366-574
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggctt

SEQ ID NO: 178610 - DNA, 882 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000520978
  CDS Start-End: 1-92
gactcctcagagctgcttctcgatgtgaacgaaaacgggaagaggcgaactccagacagatgaataaactgaggtccagagaggttaagtgacttgaccaaggtcacacagctagtcatggaagagccaggactagatctcaggtctcttgattcccagtccagtgctctttccactacaccacaatgccagtaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagccc

SEQ ID NO: 178611 - DNA, 553 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000523168
  CDS Start-End: 195-553
tatgcaggcaacatagcccttcatagcaaagcagtctgaaaaattggcacctgcaggatttgcatgtgaaaaaaacggagtcagttgcattttgccggagtctattactaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgc

SEQ ID NO: 178612 - DNA, 730 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521319
  CDS Start-End: 465-730
tgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagct

SEQ ID NO: 178613 - DNA, 564 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000520974
  CDS Start-End: 310-564
ttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctaca

SEQ ID NO: 178614 - DNA, 782 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000517919
  CDS Start-End: 377-782
ttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagt

SEQ ID NO: 178615 - DNA, 690 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000522467
  CDS Start-End: 223-690
agtctgaaaaattggcacctgcaggatttgcatgtgaaaaaaacggagtcagttgcattttgccggagtctattacttatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtg

SEQ ID NO: 178616 - DNA, 630 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000519422
  CDS Start-End: 282-392
actcactcacacacaatgtgccatcctgacaaggcttttacttctgataagctccaatgtgtgtttaatgaatacaaagccgcggtctgggtgccgcctcggccgcggccgctctcccgcgctcctttgccagaagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacc

SEQ ID NO: 178617 - DNA, 557 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521897
  CDS Start-End: 190-300
ggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatggg

SEQ ID NO: 178618 - DNA, 596 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521375
  CDS Start-End: 316-596
ctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacc

SEQ ID NO: 178619 - DNA, 1346 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521553
  CDS Start-End: 24-656
atcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggtttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttccc

SEQ ID NO: 178620 - DNA, 491 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000520428
  CDS Start-End: 347-491
aagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaat

SEQ ID NO: 178621 - DNA, 591 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518832
  CDS Start-End: 454-591
gagggcgggcgagggagacgcagacgccgcctgtgacagtggcaattccctgcgccccacatcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattct

SEQ ID NO: 178622 - DNA, 548 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000517792
  CDS Start-End: 188-548
attttctgagttcccattatatagtgtcctatgtgtgttgctcttttccagtcagactcattagtagtctggtgtggagctagtagctcagagattgcttttatgaggcggttttggaatcttcatctgcccatgaaaatagaatagtccacttttaaaaaaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaact

SEQ ID NO: 178623 - DNA, 573 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000520583
  CDS Start-End: 213-573
actcacacacaatgtgccatcctgacaaggcttttacttctgataagctccaatgtgtgtttaatgaatacaaagccgcggtctgggtgccgcctcggccgcggccgctctcccgcgctcctttgccagaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgcca

SEQ ID NO: 178624 - DNA, 548 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518954
  CDS Start-End: 387-548
acttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctcca

SEQ ID NO: 178625 - DNA, 586 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000519577
  CDS Start-End: 197-307
ttgcagctcggagcctgtggcggatggtgggactctccggccctgtgcagttatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcct

SEQ ID NO: 178626 - DNA, 1044 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000519847
  CDS Start-End: 538-1044
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactg

SEQ ID NO: 178627 - DNA, 544 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000519061
  CDS Start-End: 467-544
actcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcct

SEQ ID NO: 178628 - DNA, 572 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521733
  CDS Start-End: 268-572
gagaagaaaatagccagctttagataaagcactataacaaaggcttctagttttatatatcatggtgtccattaaagcttaatagggaagagtccattgaacctggctgggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 178629 - DNA, 2453 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000518844
  CDS Start-End: 720-2453
acttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctag

SEQ ID NO: 178630 - DNA, 870 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000521751
  CDS Start-End: 1-383
gtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttg

SEQ ID NO: 178631 - DNA, 431 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518361
  CDS Start-End: 1-96
gcttctcgatgtgaacgaaaacgggaagaggcgaactccagacagctattttcccaccagctctttcccagtatttcatatttgaatgtattgtgacttttgactatccttgcacagtcttaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaa

SEQ ID NO: 178632 - DNA, 976 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000518992
  CDS Start-End: 289-976
agaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcct

SEQ ID NO: 178633 - DNA, 7401 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000613886
  CDS Start-End: 393-2126
tctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178634 - DNA, 7372 bp, Homo sapiens
  Payload ID: 15200
  Gene Symbol: RUNX1T1
  Gene Name: runt-related transcription factor 1
  translocated to, 1 (cyclin D-related)
  ENST ID: ENST00000615601
  CDS Start-End: 343-2097
atcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178635 - DNA, 7627 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000617740
  CDS Start-End: 538-2352
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178636 - DNA, 7483 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000614812
  CDS Start-End: 394-2208
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178637 - DNA, 7687 bp, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENST ID: ENST00000613302
  CDS Start-End: 598-2412
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcctaatcatg

SEQ ID NO: 178638 - DNA, 5390 bp, Homo sapiens
  Payload ID: 15201
  Gene Symbol: RUNX2
  Gene Name: runt-related transcription factor 2
  Uniprot ID: Q13950
  ENST ID: ENST00000359524
  CDS Start-End: 93-1616
gtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttg

SEQ ID NO: 178639 - DNA, 5487 bp, Homo sapiens
  Payload ID: 15201
  Gene Symbol: RUNX2
  Gene Name: runt-related transcription factor 2
  Uniprot ID: Q13950
  ENST ID: ENST00000371432
  CDS Start-End: 211-1710
gtgtgaatgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgtta

SEQ ID NO: 178640 - DNA, 1588 bp, Homo sapiens
  Payload ID: 15201
  Gene Symbol: RUNX2
  Gene Name: runt-related transcription factor 2
  Uniprot ID: Q13950
  ENST ID: ENST00000371436
  CDS Start-End: 1-1500
atggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgt

SEQ ID NO: 178641 - DNA, 5698 bp, Homo sapiens
  Payload ID: 15201
  Gene Symbol: RUNX2
  Gene Name: runt-related transcription factor 2
  Uniprot ID: Q13950
  ENST ID: ENST00000371438
  CDS Start-End: 359-1924
caaactttctccaggaggacagcaagaagtctctggtttttaaatggttaatctccgcaggtcactaccagccaccgagaccaacagagtcagtgagtgctctctaaccacagtctatgcagtaatagtaggtccttcaaatatttgctcattctctttttgttttgtttctttgcttttcacatgttaccagctacataatttcttgacagaaaaaaataaatataaagtctatgtactccaggcatactgtaaaactaaaacaaggtttgggtatggtttgtattttcagtttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttg

SEQ ID NO: 178642 - DNA, 1770 bp, Homo sapiens
  Payload ID: 15201
  Gene Symbol: RUNX2
  Gene Name: runt-related transcription factor 2
  Uniprot ID: Q13950
  ENST ID: ENST00000465038
  CDS Start-End: 205-1770
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 178643 - DNA, 2256 bp, Homo sapiens
  Payload ID: 15201
  Gene Symbol: RUNX2
  Gene Name: runt-related transcription factor 2
  ENST ID: ENST00000576263
  CDS Start-End: 1-1629
atggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagattcagagcccagtaccttggactcccagtcttcgaccaccttgttcctctcctcggaggagccaggcccctccaccgccgccctgccatctccctcctcctcttcctgcgagcctcaggccttttccccaggtccgccagcgctgcctccgctgttgcctccgctccccgcagcctcggcgcccccaggccccggcgcctcccggcgcacaggccgctactcagtcgtcgcctcctccccggaggccgccccgcgtctggtcgactggctccccggttgcccttcgaccatctctcccagcacacgcggggatgacaaggagcggccgccgcccgtcctggcaccggccgagggcccggaaaggagccgcgccccgcgccccagcactgcgggcagggaggagggcaccgtggacgcgggtacatccccgccgccccgagcccggcccgccgctgcggcgagcttggaggcccacgtcggggacatcctggtggagctgcggaccatgaacggccacctggacagcatagcgcgggccctcaccaaactggcttcgtccctggggccccagcctgagcccctgccagatgtttcggatgccaactaatggagctcggcgaggctgggccgccccggggccgagggatcgcttgcaccaggcatccctgcctgtccctccccagcagcgaagcgcgcccagcggaggagcggttgctctgcgcagctgcctagcggaaagcacggccctagcgtttcagcgtgaaacagacccggttgcgcctcacaccctcctcctccgctctctcacggcggcccctgccccggcttcctggcccttcacatgcccttctcttgtcttgagcgtctagcagaaaaagtgcctggaaacggcggtggcaccctgcgaaggatgcttagagaaacactctttcacatcccattcctgcgacttccgcgtggcgtggagggagaggagctcaaagcaagtcgccaaagcagcagcgaggccagctccagcgttggtggggcatccatctctggtgacgttcacaagtttgtttgtttttaaaatcgtttttggaaaaatatttttttttcctcataagcacatttcaagaagtttggaaaatagagaaatgaaacaaaatctggtgtatttgtggaaaaggggggtatttaagtctttcttatgagtaagaaagtattttgtgtaataaaaaaaatgtatatccac

SEQ ID NO: 178644 - DNA, 2308 bp, Homo sapiens
  Payload ID: 15201
  Gene Symbol: RUNX2
  Gene Name: runt-related transcription factor 2
  ENST ID: ENST00000478660
  CDS Start-End: 542-1372
gcggaggcggcggcgcgggagggcggaggcgcggccgcctgcagctgggtagcagcgcgcggcgcggcgcggcggtggcgggcagcgcgcggcaatgccggccccggggctggactgctgaacccacaccgcttcaccaccggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagctcgaagccgttactcactccgctgagttgcatcactgacaagctgaagctccaccagcaggcttgcgggttttgattagttcagactcctttatttctttcaacttgggaggagggaaggctttgtttctcaagcaaatagcaggaaagggctctctggtcctagtgcctcacattttctgcagcagatggactcccatggggattcagagcccagtaccttggactcccagtcttcgaccaccttgttcctctcctcggaggagccaggcccctccaccgccgccctgccatctccctcctcctcttcctgcgagcctcaggccttttccccaggtccgccagcgctgcctccgctgttgcctccgctccccgcagcctcggcgcccccaggccccggcgcctcccggcgcacaggccgctactcagtcgtcgcctcctccccggaggccgccccgcgtctggtcgactggctccccggttgcccttcgaccatctctcccagcacacgcggggatgacaaggagcggccgccgcccgtcctggcaccggccgagggcccggaaaggagccgcgccccgcgccccagcactgcgggcagggaggagggcaccgtggacgcgggtacatccccgccgccccgagcccggcccgccgctgcggcgagcttggaggcccacgtcggggacatcctggtggagctgcggaccatgaacggccacctggacagcatagcgcgggccctcaccaaactggcttcgtccctggggccccagcctgagcccctgccagatgtttcggatgccaactaatggagctcggcgaggctgggccgccccggggccgagggatcgcttgcaccaggcatccctgcctgtccctccccagcagcgaagcgcgcccagcggaggagcggttgctctgcgcagctgcctagcggaaagcacggccctagcgtttca

SEQ ID NO: 178645 - DNA, 1475 bp, Homo sapiens
  Payload ID: 15201
  Gene Symbol: RUNX2
  Gene Name: runt-related transcription factor 2
  ENST ID: ENST00000483377
  CDS Start-End: 371-484
gagaaagagagagagagaaagagcaagggggaaaagccacagtggtaggcagtcccactttacttaagagtactgtgaggtcacaaaccacatgattctgcctctccagtaatagtgcttgcaaaaaaaaggagttttaaagcttttgcttttttggattgtgtgaatgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttggggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccag

SEQ ID NO: 178646 - DNA, 1458 bp, Homo sapiens
  Payload ID: 15201
  Gene Symbol: RUNX2
  Gene Name: runt-related transcription factor 2
  ENST ID: ENST00000625924
  CDS Start-End: 1-1458
atgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 178647 - DNA, 3861 bp, Homo sapiens
  Payload ID: 15202
  Gene Symbol: RUNX3
  Gene Name: runt-related transcription factor 3
  Uniprot ID: Q13761
  ENST ID: ENST00000308873
  CDS Start-End: 10-1257
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgt

SEQ ID NO: 178648 - DNA, 2629 bp, Homo sapiens
  Payload ID: 15202
  Gene Symbol: RUNX3
  Gene Name: runt-related transcription factor 3
  Uniprot ID: Q13761
  ENST ID: ENST00000338888
  CDS Start-End: 247-1536
ggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaa

SEQ ID NO: 178649 - DNA, 4340 bp, Homo sapiens
  Payload ID: 15202
  Gene Symbol: RUNX3
  Gene Name: runt-related transcription factor 3
  Uniprot ID: Q13761
  ENST ID: ENST00000399916
  CDS Start-End: 440-1729
attcattcattccccgtggcactggaggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttgggtacaaacagaaacttactttccttggggatttttttctctctctcactcacacacactctcgcgttctttccttttttctttttcgtagcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaagga

SEQ ID NO: 178650 - DNA, 1761 bp, Homo sapiens
  Payload ID: 15203
  Gene Symbol: RUVBL1
  Gene Name: RuvB-like AAA ATPase 1
  Uniprot ID: Q9Y265
  ENST ID: ENST00000322623
  CDS Start-End: 101-1471
gcaaattgccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 178651 - DNA, 872 bp, Homo sapiens
  Payload ID: 15203
  Gene Symbol: RUVBL1
  Gene Name: RuvB-like AAA ATPase 1
  ENST ID: ENST00000478892
  CDS Start-End: 1-804
aggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcttaggtgatgggattaattttgccccttacagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgc

SEQ ID NO: 178652 - DNA, 913 bp, Homo sapiens
  Payload ID: 15203
  Gene Symbol: RUVBL1
  Gene Name: RuvB-like AAA ATPase 1
  ENST ID: ENST00000472125
  CDS Start-End: 1-667
gaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcaggtcccatgactcaatgaacatgcttgtccagctcatctggaaacctgctgccttcaaataccatctcatcgtttcaacacaatatgatgacagtgcaccccacagagtgggggactgcacacaaggcattctgaaacttaaatccagaccatggaaactccctggggttggatctggacacacctggaaatagatgaccactgcaaagacaaagatggtggcgatgagattcatgaggttgggaagattctggcggtagaacgcctcccgaagggctcggaccttgtctgtgcgtgtggccagcagatggaaaagtgcgatgatagcaccttcaaattccattcctgttggcagaggaggagacatatatgaaggaacgaacaggcaactcaatttgcttctagccttcttagcagacaaataaaaagaggaaaacaaa

SEQ ID NO: 178653 - DNA, 2126 bp, Homo sapiens
  Payload ID: 15203
  Gene Symbol: RUVBL1
  Gene Name: RuvB-like AAA ATPase 1
  ENST ID: ENST00000464873
  CDS Start-End: 752-1699
gtcccggcaaaggctcgagcgaattcggacacggggcccggtcgctccgcccgcgtccctgagcccggctcccgccccggcccgcgctcaccgccgatgatggtccggatgagggaggcgtgcccggggcagtcgaccagcgtgacctgaagcagtggctcgccgggctcgggctcggcctcgggcgctgcctggaactcgggcaaagacgaccgcaggcgcgcgggcagcggcaccgagaagcacgagaagcccagatcgagcgtgatgccgcgctcgcggctctgcggctgcttgtcaaaggcggcggtggaggctgtggtgcttagcgcccgcgccagcgccgtcttgccgctgtcgatgtggcccagcacgcccacgttcacgttcacccgccgccctgccatgccgccgccgccgcctcggacacccgcccggcccgcccctcacctccctcggtagtcgccgcggtccggcccgttaagttgcccccccgtaaccggcgcgctgtgcacacccgttccggcccggaagcttccgccctcctgaggctcacgggcacagccgagcgccgtgctccgagtgggtggtctaggaactggaggtcaccgtaggcagggtttctctctcacgtggctcctcctgcctgaagcctctaggagcccgagatggagggatccttctgagaagtgaagccatttggactttctgggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacaggtcccatgactcaatgaacatgcttgtccagctcatctggaaacctgctgccttcaaataccatctcatcgtttcaacacaatatgatgacagtgcaccccacagagtgggggactgcacacaaggcattctgaaacttaaatccagaccatggaaactccctggggttggatctggacacacctggaaatagatgaccactgcaaagacaaagatggtggcgatgagattcatgaggttgggaagattctggcggtagaacgcctcccgaagggctcggaccttgtctgtgcgtgtggccagcagatggaaaagtgcgatgatagcaccttcaaattccattcctgttggcagaggaggagacatatatgaaggaacgaacaggcaactcaatttgcttctagccttcttagcagacaaataaaaagaggaaaac

SEQ ID NO: 178654 - DNA, 1113 bp, Homo sapiens
  Payload ID: 15203
  Gene Symbol: RUVBL1
  Gene Name: RuvB-like AAA ATPase 1
  ENST ID: ENST00000585057
  CDS Start-End: 1-396
aaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtaaggcccataggacaacctggtctgcagctgactttgtagccagctttgtaggaacacggccatgctcatttgtctgttgtctgtctgtggctgcttctgagtgacgatggaagagatgagtagttgtactgaggactgtgcagactgaagagtgctgtggcagcatctaaggtcacctggactttgcccttccttacctaactgctccatctccaagggtacagctgtatctggcaccatcacctctggcccaaactctcaccacagcctggcaggtcccatgactcaatgaacatgcttgtccagctcatctggaaacctgctgccttcaaataccatctcatcgtttcaacacaatatgatgacagtgcaccccacagagtgggggactgcacacaaggcattctgaaacttaaatccagaccatggaaactccctggggttggatctggacacacctggaaatagatgaccactgcaaagacaaagatggtggcgatgagattcatgaggttgggaagattctggcggtagaacgcctcccgaagggctcggaccttgtctgtgcgtgtggccagcagatggaaaagtgcgatgatagcaccttcaaattccattcctgttggcagaggaggagacatatatgaaggaacgaacaggcaactcaatttgcttctagccttcttagcagacaaataaaaagaggaaaacaaactta

SEQ ID NO: 178655 - DNA, 1478 bp, Homo sapiens
  Payload ID: 15204
  Gene Symbol: RUVBL2
  Gene Name: RuvB-like AAA ATPase 2
  ENST ID: ENST00000221413
  CDS Start-End: 14-793
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaagggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 178656 - DNA, 682 bp, Homo sapiens
  Payload ID: 15204
  Gene Symbol: RUVBL2
  Gene Name: RuvB-like AAA ATPase 2
  ENST ID: ENST00000596837
  CDS Start-End: 356-682
actcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacg

SEQ ID NO: 178657 - DNA, 813 bp, Homo sapiens
  Payload ID: 15204
  Gene Symbol: RUVBL2
  Gene Name: RuvB-like AAA ATPase 2
  ENST ID: ENST00000593570
  CDS Start-End: 3-122
tcatggcaaccgttacagccacaaccaaagtcccggagatccgtgatgtaacaaggattgagcgaatcgagatggagtttccccgtgttagccaggatggtctcgatctcctgacctcgtgatccgcccgcctcggcctcccaaagtgctggaattacaggcatgagccaccgcgcctggccaaaaaacaataaaaaattaaaaaaaaaaaaaaaggatgaagagccaagcaccgcttgtgagctgaggacccagtagagactagctgcacccaggagcctcccttggggtgctcacagtcaagcactggggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccgg

SEQ ID NO: 178658 - DNA, 572 bp, Homo sapiens
  Payload ID: 15204
  Gene Symbol: RUVBL2
  Gene Name: RuvB-like AAA ATPase 2
  ENST ID: ENST00000595811
  CDS Start-End: 24-158
gactctggcagttggtgagcatcatggcaaccgttgaactccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctg

SEQ ID NO: 178659 - DNA, 1641 bp, Homo sapiens
  Payload ID: 15204
  Gene Symbol: RUVBL2
  Gene Name: RuvB-like AAA ATPase 2
  ENST ID: ENST00000601968
  CDS Start-End: 465-1529
gggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttgacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccgggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgaca

SEQ ID NO: 178660 - DNA, 1563 bp, Homo sapiens
  Payload ID: 15204
  Gene Symbol: RUVBL2
  Gene Name: RuvB-like AAA ATPase 2
  ENST ID: ENST00000596247
  CDS Start-End: 15-167
agttggtgagcatcatggcaaccgttacagccacaaccaaagtcccggagatccgtgatgtaacaaggattgagcgaatcggtgcccactcccacatccggggactggggctggacgatgccttggagcctcggcagcttcctgatgtggtagaaatgccatggtagccccacaggaaatcacctcatgtgcgcctcccacccacaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcaccc

SEQ ID NO: 178661 - DNA, 2009 bp, Homo sapiens
  Payload ID: 15204
  Gene Symbol: RUVBL2
  Gene Name: RuvB-like AAA ATPase 2
  Uniprot ID: Q9Y230
  ENST ID: ENST00000595090
  CDS Start-End: 465-1856
gtgtcccggccccgcctcggccgtgagacctccagggggcggagcttgccgctgcgctttacggaaacgagtggccttcagctctgtcaatctggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacacctccagagtgcggattgagaagcc

SEQ ID NO: 178662 - DNA, 1065 bp, Homo sapiens
  Payload ID: 15204
  Gene Symbol: RUVBL2
  Gene Name: RuvB-like AAA ATPase 2
  ENST ID: ENST00000627972
  CDS Start-End: 1-1065
atggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccgggtacagaagtgcaggtggatgacatcaagcgggtctactcactcttcctggacgagtcccgctccacgcagtacatga

SEQ ID NO: 178663 - DNA, 5522 bp, Homo sapiens
  Payload ID: 15205
  Gene Symbol: RWDD1
  Gene Name: RWD domain containing 1
  Uniprot ID: Q9H446
  ENST ID: ENST00000466444
  CDS Start-End: 217-948
agaacgagtcgaacgtggaagtagggagcaggcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaatataaaatgttcaaggcttcttactgttgagcacaaggttacgtatttaaaatcacctagtatttgagagagatcctgcctatagcaccaagactcgaaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatgaagtttagccttccttttagtccattttgtattgccgtaaaggaatatctgaggctgggtaatttataaaaggtttgccgggtgcggtggctcacgcctgtaatcccagcactttgggaggctgaggcaggtggatcacgaggtcaggagattgagaccatcctggctaacacggtgaaaccccgtctctattaaaaatacaaaaaattagccaggtgtggtggcgagcacctgtagtcccaactactcgggaggctgaggcaggacaatggcgtgaacccgggaggtggagcttgcagtgagccgagatcacgccactgcactccagcctgggcaacagagcaagactccgtctcaaaaaaaaaaaaaaggtttatttggctcataattctggatgaccagaaagttgaagattgggtatctgcatctggtgagagcctcacgctgcttccactcatggtagaaggggaagaggcactatgtgtgtagagatcacatggccagagagtgagggtggaagtgccaggctttttttttttttttaaactagctttggtgggaactccctcacccctgctccccacaggaaggcattaatctatttatgagggatctacctgctataacccaaacaccccaccagcccccatctcccaacaccaccacactggggattaaatttcaatgtgggatttggagaggacaaatatccaaaccatagcagtcttaaagtatttaaattagaatttaaattaaaatttaaattacagtatttaaattagaatcatttgtggagtttctaaaaggtatgcattcctaggcccctctcaagttagatttatgaacactgatccccagtctgaattttaaaacagcaaaatctcatactggttctacagattattctgatgcacaatctgggttaagaaccactgtcctgtagtcgtgaagtctatatattttggtattttctttacctcttctctaattaaccagtctgaaggagtttgaattttggggatcgtacattgtctgcaagagaaacacattaacatccgtgcacatagagtcctttgtaataatttgggatgattgacttggtggctccaggtaggagagccagtcttcatgcaagttattcagtcactacagttttggaggactgactcttaaccccaataggaaatcagttgtgctattttaaattcataaagctattataaagagctgcctccagtaaaaaatacatatgccacatacccacaaacagcaatattaagccttcatttattgttggagttagaccttataatcaaaaagcaaattatttaagataaaattaccattgaggagtttaatacttttcaaggaatcttcacgtcagccttgatcccagaccaatagaatggaataacaacaggaatgttcagcatttctttgcagagagaaatccaaaagtttgtcctatgtgagattttgcttttcccatctttttgaagctgatcagcagatacataagaacctggaagaagctgctcaattaaggttaaaaaaaataaaaagcaattgttagcaatgtggtgctgaaatcaagacttaactttgaagtgtcaagaatgataacctcccatccacttcatgtgatttttaagaataaattttatatatttctccaggtattaaagtggatgtccacctttgccatttcagaacctaaaggcagaatctaatggtaaaatgaagacaacctagttgtcttctaataacctagttagttctaataacattctcaaatattttcatctagagtaaatatttactgttggctttgtattctgggaattagcccaagactatgctgctcaaatgggtgcaaatatactctcaggttgcaatagcatgacgagtggtatttgaagcaataattgttccatcttggattatcggttttgctctttgatttggtaaagtttttgtttttctactcgtgccagttgtattaaaatgtcactaggttaaaaacaaacacagatatgtttattcattactgtatccctgtaataatgcctggcatgcagtaggtccctaatatttgttgaatgaatgaattatagaatagagtgcaaaattaattctaatgtattttaaagtaaagcatgagagttcaaagaaatgttgtatttgccatctacaacttggaataatgttccttgatcctgctttacttcatgcacttttgccagcagaggtggatgccttagggaaaaagttggataaatgctgatctaaggcaacacgtctaaatggttatgtgaacatttcccagttggggtaaaactaagaggagtgataataacatctcatcaatttaaaggacaagttcactgatcgtactgtcatactccagagatacatgtgccaagaagcaaagagatgcactcttgtattccagaaagaagatgatttgtaagtgttcagtatttgtgtggcagcccttttaggtgtaatgaagtgtaacagaaaagtaagtgaactacttcacatagctcttaatgtttgtctttcagaggacatacgagtcaggcagcaaaagttggagccattgtatgattgtgtgtcaaaatgagagtcacacacttcaagaactgtaggaactaattttagaaaaagactcttcagaacagatgacacatgaaatgtgagtttatgtaaacatgtaaatttgagtagcattagtttgttttctgtttaggaactgtatcagggtgacaaagatgaaagaatgctgccagaaaagtatattgttaaattttcaggcctccattggtgaagtttcaagtaacctttcacttaagttacttgtgtcagaggatggatgatggggtcatttaaattgttggacaaagccatgaaaggacttttaaaattttgtcataaaaatagccaatgatgtttttaattttacatctaaaactaatttgcattatcctgtgttagtgactgaatctcaactcagtcctcattttttagttcaacttttgacaaccttatattcattgacaccatggacagcacagtaaaaaaatacacaaatttcttttgcagttattgatttggaatgatcactttaaaagagccatcaaatacgcctacatattgagccactctttatcattaaggtgaaaagttcattcaattaaggtatttgagtgctactatgcgccagcctttctttgtgataatgttaattttttttttcctcccctccatgaagggaagaaaaaaaaattaattcggccatgaattttaatattctggccagcaccttatccatttgtagccacgccaacaaatttattctgtgatataccaaacttacaaagtcactctgcgatttcagtaaggcccattcccaacatgagtgctgctgtccacggtactgaaccatcaatgctaaatggtatttagttgtggatcttcatcctgtcatgcagctaaatattccaggaatactgaaccaagtgaggagaaagatagcagtgggttgctgcaaaggaggtgaggggaggggagagatagcaagtgagaaaaagagagactagtggtgatgtttttaagtaattgaagtaaaaaagagagagaaagagagagagaagaggttctactcagtccaccaaagctttttaatttccttacataattaacatgatgaatttttaaataattgttatatttagttttgttcttccaccttttggctatttctactacatatttacttatcataaaaaatacttcctagaccttcctcttatagctattgcctatctctgcctttgcagctgttctcctttaaagagtagtctccattagttttcttgacttcttcatctccctgcataaagatgaagggtatttagctctgaaaatcctttactgttgaatatttagattgttttcaatttttacataatgaacaatgcatcatgggattattggctgcaaataaattggaaacataaaaggtgttttaagtttaaatttttttaaaaaaacaggtaaaaataaaatatttgccaaagactaa

SEQ ID NO: 178664 - DNA, 505 bp, Homo sapiens
  Payload ID: 15205
  Gene Symbol: RWDD1
  Gene Name: RWD domain containing 1
  ENST ID: ENST00000468204
  CDS Start-End: 304-505
ctaggactgggtactgataatttgctaataaggaaaagcatctgccttagaaagcatttcaataacttctgtgtgtattttcttgcagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttgg

SEQ ID NO: 178665 - DNA, 1427 bp, Homo sapiens
  Payload ID: 15205
  Gene Symbol: RWDD1
  Gene Name: RWD domain containing 1
  Uniprot ID: Q9H446
  ENST ID: ENST00000487832
  CDS Start-End: 497-940
tggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaatataaaatgttcaaggcttcttactgttgagcacaaggttacgtatttaaaatcacctagtatttgagagagatcctgcctatagcaccaagactcgaaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatg

SEQ ID NO: 178666 - DNA, 857 bp, Homo sapiens
  Payload ID: 15205
  Gene Symbol: RWDD1
  Gene Name: RWD domain containing 1
  ENST ID: ENST00000368590
  CDS Start-End: 705-857
cgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttaca

SEQ ID NO: 178667 - DNA, 581 bp, Homo sapiens
  Payload ID: 15205
  Gene Symbol: RWDD1
  Gene Name: RWD domain containing 1
  ENST ID: ENST00000518117
  CDS Start-End: 366-581
gggcaagagcaagggccacgatgacagattacggcgaggagcagcgcaacgagctggaggccctggagtccatctaccctgactccttcacagacatatgggacttgggattcagctccagctgagattgagagagcagaagattacttgtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaa

SEQ ID NO: 178668 - DNA, 3744 bp, Homo sapiens
  Payload ID: 15206
  Gene Symbol: RWDD2A
  Gene Name: RWD domain containing 2A
  Uniprot ID: Q9UIY3
  ENST ID: ENST00000369724
  CDS Start-End: 206-1084
ctgaggaactgcggctgcggttccgagcggggtctggggctgttaccattgagtgaccagaaaggctctcggtgcaaagcgttcctgcagaattgcttccacgtaaagggaccttcgggaaatttcgctggataccggctggcattgacaaacccagcgtccctgagccttgtgaggtttccaggcaggctgattgcgaggcaacatgtctgcttcggtgaaagaaagccttcagcttcagctactggagatggaaatgctgttttctatgtttcctaaccaaggagaagtaaaacttgaagatgtaaatgccctgacgaatataaagaggtatttggaaggcacaagggaggcgctgccaccaaaaatcgaatttgtaattacactccagattgaagagcccaaggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaacttgtgaagctgatttgattgaagaggaatccaaagcccataactaacatcaaaaatcaaactgcaattatgaattgagaaatatgaatagcatttgtttcacattgctagcacacatgtgacacacccacttgtctttcattattggaaatctaaatcaagtttaaaatgagaacaggaaggacatgtttacttccttttttgagacggtgcgatctcggctcactgcatcctcagcttcccaggttcaagcgattctcctgcctcagcctcccaagtagctgggactacaggcgtgcgccaccacgcccagctaattgttatatttttagtagagacagggtttcatcatgttggctaggatggtctcaatctcttaacctcgtgatctgcctgcctcggccttccaaagtgctgggattacaggtgtgagccaccgcgcccagcccgtttacttcatttcttactttaaactcctatttcgagtgttttagtaaaactagatcctaatagcagtggcaaaggactcatagacatgaagtcccacgagttaaaagatgacacacaatgctatgtgttctggctgtttatatcagttcatgatactagcaatcctgataccagtattagtttaattcttatccagaaaagataaacacatggttccttgtctacaaagtattcgcctgtttcaatccaacctttgcctgtgtgccagtatgcattactataaagggcaagagactgttgaggggaccagtgtggatatctgcatcattaccttattgggaaaaaaaaaatctaattctacagtccgatgatgttactgccatctcctctgaaaattccaagctccacaggcttcaccaggcttttcaaaatgagagtttattttaatgattaaaaaccgctatttaagtagctcttgccaagccttttcattaccaggtctccatccctccccaagtatttctgcgagtctcatgtgctaagagatgtcttgagcagcctctgcagctttccgtgtttctgtggtcagctactgctgccctttcccgggaggcattccattctcctactgggtcctctcaagatgccaaagcttggtgctgggatttaggaacacatcctgttagatgtcagacagtgctgcttgtgctggggagcctacagaacttctgatgaaactaccatctggttttaccctctgtgccgtggatgcagacgtgtccttgggctacagagaggacatgatggagcaggaggccctatcccaaggaggtgttagaactgggtccactttgtactgcctctttcttcttaggtcacaatgagtgtcctctcagggcacaactcagatcttcaacccatggctcgctgtaggcctgccccgccaggtcctccagcttgccattcatgtttccatcctagccttggttgtgctggaactcaggctggagcctgacactttgcctatatgcaaagggaagaaataggacttacattgccaaggaatcacttcttaatgtttgccagcactaaaaacaacaaagtataggaatctttttcccccacagtctccacaaagctatcaataagtataattcgcatttacaagttttaggccttcaacagatgtaactccatccaaatgaatcaatatgtgccatcaacctaccttatagaggtgtttttcctgattacatgagcaaaagtagctacagaaagatgggtgtaaagaaaaggcaataaattctaggttatgaactctactgcttctggagctatttctgagatttttcagaacctacttttttataaataagtctaatttgagcattctgcaatactttttttcctatcaggaaaactaatgcagatagtattatggggacgtgtaggttttatagaaaaaaaaagtacatgtataattcaaaactcaactttgtatgtataggagtctgctggttgtttgcacagcctgatatgagcacataataaaagtccgtcattccccaaccccctccccctacacacacagcttattttgggaaactgccccttccctgtgtgatttgggaagagaaagtgataggaatcaagttgtcctctggcagcctcctggagagatggctgtgagctcttgctgcttaaacctctagtgccaccctcatttctgacctactgaatgctcagctgtttggcatttcctttgaatgacccagcatcttcccttttgttgtcggaaatcagaatcagtctctattgcttgtaacttaagaatctggatattctgtttattatattcttaaatggttatttggaaaatgtgctcatttataaaagttacagtgtctttttaaagtttgctgaagtaaatgaagcatatcgtcaa

SEQ ID NO: 178669 - DNA, 3094 bp, Homo sapiens
  Payload ID: 15207
  Gene Symbol: RWDD2B
  Gene Name: RWD domain containing 2B
  Uniprot ID: P57060
  ENST ID: ENST00000493196
  CDS Start-End: 102-1061
atgcgccgcatgctttttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacgaagggccaagagaaccacgaagatgccagttgccacattgttgagctgctgacccaacaccagccattgcctgtctctaaacatcttatgaaataaaaccagttttgtttaatttctaggctttttttttaaatagacggagtcttgctctgtcgcccgggctagagtgcaatggtgcaacctccgctcactgcaacctccgcctcccaagttcaagcgattctcctgcctcagcctcccaagtagctgagattacaggcgcccgccaccatgcctggctaatttttgtgttttttagtagagacagggtgtcaccattttggccaggctggtcttgaactcctgacctcaggtgatcctcccacctcggcttcccaatgtgcttggattacaggcataagccaccgtgcctggccaatatctaggctttttactagcagttgaaagctagtttgtcaaatagagtttttcagagctttagttttgcatttaccccagccttttgatacacaaataggtgaagtttttctgaagtggagtttgcagttccccactttttgtatactcacgctctgcccctgctcctgggcttgcctcagacaaggctgaggcattagtagggcttaaacttttttaacaagcctcaacaattcatcaaattagtaatttagaaaatttgtttggcaaattgtattctgacattttttgttctggaaatggctttctgtacatttatttttgccaaattgacctagcattaaataaacacaccacccagtttttgaggacctccataaaccagttagttccaaaagcatttattatttgctaatttgctagcatgcaggttgatgcaggttgataccaggtgttggatatttcttgaccagtcagacttggttaaggaatggagttggggtgagagacaatgcattaagttagtaaaaggttgtaggcaaactatgcttatcacaaaatgaatcagttagtaaaagacagcatatattatgtaatacaatgtagaaatctgaaggaataaaatggaagaaggcaatgtggatagatcttaaatataaaggtggttaaacataaatgagaatcagaatggtatttaaagcacagtgcttgtattggacctaaatcttatgtacgtccccagatttcctccctgctgccctgtcctatcgccccgtcagttgccctggaaatcccagttcctctgctgccaccagacagccaggtggaccagttgtgtgtctagtttctgattcctccagcgactaacagatttgtatgaaataccctacagagaatggaatctgacatccctaccaccaaagggggcagatgatgcatatattactttaagcagctaaagtggcagctaaactgctaaaactttttcagtctctctacattatattaaaaaccagattgctatgtataatatgcagatctcaaatgtcacataaacacatagaatgcaa

SEQ ID NO: 178670 - DNA, 1078 bp, Homo sapiens
  Payload ID: 15208
  Gene Symbol: RWDD3
  Gene Name: RWD domain containing 3
  Uniprot ID: Q9Y3V2
  ENST ID: ENST00000263893
  CDS Start-End: 21-608
aggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgtggatatacctctggaattggtgttccatttgccagtcaattatccttcatgtctacctggtatctcgattaactctgaacagttgaccagggcccagtgtgtgactgtgaaagagaatttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccaaaaagttaaatgtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaa

SEQ ID NO: 178671 - DNA, 1235 bp, Homo sapiens
  Payload ID: 15208
  Gene Symbol: RWDD3
  Gene Name: RWD domain containing 3
  Uniprot ID: Q9Y3V2
  ENST ID: ENST00000370202
  CDS Start-End: 77-880
agtgctgctcctggccggtggaggcggcggctgcggcagcggaaggggaagcgctgaggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgtggatatacctctggaattggtgttccatttgccagtcaattatccttcatgtctacctggtatctcgattaactctgaacagttgaccagggcccagtgtgtgactgtgaaagagaatttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaaga

SEQ ID NO: 178672 - DNA, 2590 bp, Homo sapiens
  Payload ID: 15209
  Gene Symbol: RWDD4
  Gene Name: RWD domain containing 4
  ENST ID: ENST00000327570
  CDS Start-End: 227-790
aggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacagcg

SEQ ID NO: 178673 - DNA, 2641 bp, Homo sapiens
  Payload ID: 15209
  Gene Symbol: RWDD4
  Gene Name: RWD domain containing 4
  Uniprot ID: Q6NW29
  ENST ID: ENST00000326397
  CDS Start-End: 274-840
gaactttacgccgctcctccaagcgtcagggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacagcga

SEQ ID NO: 178674 - DNA, 805 bp, Homo sapiens
  Payload ID: 15209
  Gene Symbol: RWDD4
  Gene Name: RWD domain containing 4
  ENST ID: ENST00000514322
  CDS Start-End: 252-413
gcgtcagggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgacttttta

SEQ ID NO: 178675 - DNA, 264 bp, Homo sapiens
  Payload ID: 15209
  Gene Symbol: RWDD4
  Gene Name: RWD domain containing 4
  ENST ID: ENST00000506467
  CDS Start-End: 136-264
tgtggtaagtatctaaggttatataagttagtcaagcttttacatagttgagtgggcttgaatgagaaagtaaagaccctctatttctaattcatttataccactaaacaaaactcattcagttctttatttcagatggaactagaagcattacgctctatttatgaaggagatgaaagtttccgggaattaagtccagtttcttttcaatataggataggtgaaaatggtgatcccaaagccttcttaatagagatttcctgg

SEQ ID NO: 178676 - DNA, 1393 bp, Homo sapiens
  Payload ID: 15209
  Gene Symbol: RWDD4
  Gene Name: RWD domain containing 4
  ENST ID: ENST00000512740
  CDS Start-End: 309-686
ggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggaggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgc

SEQ ID NO: 178677 - DNA, 1551 bp, Homo sapiens
  Payload ID: 15209
  Gene Symbol: RWDD4
  Gene Name: RWD domain containing 4
  Uniprot ID: Q6NW29
  ENST ID: ENST00000510968
  CDS Start-End: 294-575
gtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtc

SEQ ID NO: 178678 - DNA, 1620 bp, Homo sapiens
  Payload ID: 15209
  Gene Symbol: RWDD4
  Gene Name: RWD domain containing 4
  ENST ID: ENST00000510702
  CDS Start-End: 250-384
gtcagggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatatagggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaa

SEQ ID NO: 178679 - DNA, 15377 bp, Homo sapiens
  Payload ID: 15210
  Gene Symbol: RYR1
  Gene Name: ryanodine receptor 1 (skeletal)
  Uniprot ID: P21817
  ENST ID: ENST00000355481
  CDS Start-End: 132-15233
atctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 178680 - DNA, 15117 bp, Homo sapiens
  Payload ID: 15210
  Gene Symbol: RYR1
  Gene Name: ryanodine receptor 1 (skeletal)
  Uniprot ID: P21817
  ENST ID: ENST00000359596
  CDS Start-End: 1-15117
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctga

SEQ ID NO: 178681 - DNA, 15348 bp, Homo sapiens
  Payload ID: 15210
  Gene Symbol: RYR1
  Gene Name: ryanodine receptor 1 (skeletal)
  ENST ID: ENST00000360985
  CDS Start-End: 108-15206
gtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggagaggcgcacccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccag

SEQ ID NO: 178682 - DNA, 515 bp, Homo sapiens
  Payload ID: 15210
  Gene Symbol: RYR1
  Gene Name: ryanodine receptor 1 (skeletal)
  ENST ID: ENST00000596431
  CDS Start-End: 1-515
gagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactggagagaaggtcatggcggatgatgaattcacacaagacctgttccgattcctacaattgctctgtgaggggcacaataatggcgctctgcagtggctgccaaagttctatacacgtggtggatttctgtactttaggtccagaaaagacctaagggaaaaaactgcctggcatttaaaaataaatctattagaatc

SEQ ID NO: 178683 - DNA, 6263 bp, Homo sapiens
  Payload ID: 15210
  Gene Symbol: RYR1
  Gene Name: ryanodine receptor 1 (skeletal)
  ENST ID: ENST00000594335
  CDS Start-End: 1-2659
gaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtg

SEQ ID NO: 178684 - DNA, 843 bp, Homo sapiens
  Payload ID: 15210
  Gene Symbol: RYR1
  Gene Name: ryanodine receptor 1 (skeletal)
  ENST ID: ENST00000593322
  CDS Start-End: 1-239
cacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcaggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggac

SEQ ID NO: 178685 - DNA, 2200 bp, Homo sapiens
  Payload ID: 15210
  Gene Symbol: RYR1
  Gene Name: ryanodine receptor 1 (skeletal)
  ENST ID: ENST00000599547
  CDS Start-End: 1-2200
aaacttgctgctctcgtccgccaccgagtctctctctttggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaa

SEQ ID NO: 178686 - DNA, 432 bp, Homo sapiens
  Payload ID: 15210
  Gene Symbol: RYR1
  Gene Name: ryanodine receptor 1 (skeletal)
  ENST ID: ENST00000593677
  CDS Start-End: 1-432
aggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctct

SEQ ID NO: 178687 - DNA, 863 bp, Homo sapiens
  Payload ID: 15210
  Gene Symbol: RYR1
  Gene Name: ryanodine receptor 1 (skeletal)
  ENST ID: ENST00000601514
  CDS Start-End: 1-863
cgtggtcctggctctgtgggacctggcctaggatggaaacttaggtctggaggcggagtcaggaccctgactctgttggtggagacaaggttttccttctgccgtaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgagga

SEQ ID NO: 178688 - DNA, 14850 bp, Homo sapiens
  Payload ID: 15211
  Gene Symbol: RYR2
  Gene Name: ryanodine receptor 2 (cardiac)
  ENST ID: ENST00000360064
  CDS Start-End: 1-14850
gatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggctcttctctctaaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctcgtcacagcagcattctctcggagagcttatgttttgtttgtttgttttcataggggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaat

SEQ ID NO: 178689 - DNA, 16562 bp, Homo sapiens
  Payload ID: 15211
  Gene Symbol: RYR2
  Gene Name: ryanodine receptor 2 (cardiac)
  Uniprot ID: Q92736
  ENST ID: ENST00000366574
  CDS Start-End: 318-15221
ccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttcttagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagataccgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctggtggaacatcctcagagatctaaaaaggctgtatggcataaactactgtccaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 178690 - DNA, 15552 bp, Homo sapiens
  Payload ID: 15212
  Gene Symbol: RYR3
  Gene Name: ryanodine receptor 3
  Uniprot ID: Q15413
  ENST ID: ENST00000389232
  CDS Start-End: 71-14680
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtacc

SEQ ID NO: 178691 - DNA, 15557 bp, Homo sapiens
  Payload ID: 15212
  Gene Symbol: RYR3
  Gene Name: ryanodine receptor 3
  Uniprot ID: Q15413
  ENST ID: ENST00000415757
  CDS Start-End: 85-14682
gcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaat

SEQ ID NO: 178692 - DNA, 15564 bp, Homo sapiens
  Payload ID: 15212
  Gene Symbol: RYR3
  Gene Name: ryanodine receptor 3
  ENST ID: ENST00000622037
  CDS Start-End: 71-14692
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtaatgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaacacatgcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtacc

SEQ ID NO: 178693 - DNA, 15591 bp, Homo sapiens
  Payload ID: 15212
  Gene Symbol: RYR3
  Gene Name: ryanodine receptor 3
  ENST ID: ENST00000634891
  CDS Start-End: 102-14714
ggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaatac

SEQ ID NO: 178694 - DNA, 137 bp, Homo sapiens
  Payload ID: 15212
  Gene Symbol: RYR3
  Gene Name: ryanodine receptor 3
  ENST ID: ENST00000634750
  CDS Start-End: 1-137
gcgaggacgagatccagtttctgaggacttacattcctccagatctctgcgtctgcaattttgtgctggaacagtccctatctgtcagagccctgcaggaaatgcttgccaacacaggtgaaaatggcggcgaaggg

SEQ ID NO: 178695 - DNA, 2743 bp, Homo sapiens
  Payload ID: 15212
  Gene Symbol: RYR3
  Gene Name: ryanodine receptor 3
  ENST ID: ENST00000634730
  CDS Start-End: 1-1848
agagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacaatgaagtgcccactgcaataaagtaatacgtaccaatacctccagggtctggactct

SEQ ID NO: 178696 - DNA, 15078 bp, Homo sapiens
  Payload ID: 15212
  Gene Symbol: RYR3
  Gene Name: ryanodine receptor 3
  ENST ID: ENST00000634418
  CDS Start-End: 1-14580
atggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccaggtctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagcggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatgtctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatacccaggaggtggagaaggatggggaggcaatggtgttggtgacgacctgtactcctatggctttgatggacttcacctttggtcaggccggatacccagagctgtggcttccatcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatccgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcacgggggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttgctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacgttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaatctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccagacacaaaattaataatttcttcctgagcacctttcaacaagtttggctggaaaaggttaatgaaaaaactcagtatgacaggcttatacccattttaatgaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcagagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacacgtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactcactccaaaagataataactgcagtctaatttttcccatggtacttgctagtgactgtatccagaaaagctttaagcagttaaa

SEQ ID NO: 178697 - DNA, 3681 bp, Homo sapiens
  Payload ID: 15213
  Gene Symbol: SRBD1
  Gene Name: S1 RNA binding domain 1
  Uniprot ID: Q8N5C6
  ENST ID: ENST00000263736
  CDS Start-End: 64-3051
gggaaccggaaggtgcggtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacgggctgttgcaaagaaagttcatagtacaatccagaaaattaagaaggaagggaagatgtctgagtgcttgttaaaagccatgctgaattgtaaaacttttgaagaactagaacacgtgtctgctccatataaaactggaagcaaagggactaaagcccagagagcaagacagttgggcttagaaggagcagccagggcactgcttgagaaaccaggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 178698 - DNA, 594 bp, Homo sapiens
  Payload ID: 15214
  Gene Symbol: S100A1
  Gene Name: S100 calcium binding protein A1
  Uniprot ID: P23297
  ENST ID: ENST00000292169
  CDS Start-End: 114-398
ggactgttgaagacaggtctccacacacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcaccagc

SEQ ID NO: 178699 - DNA, 522 bp, Homo sapiens
  Payload ID: 15214
  Gene Symbol: S100A1
  Gene Name: S100 calcium binding protein A1
  ENST ID: ENST00000368696
  CDS Start-End: 89-250
cacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgaaagagcttatgctgtaggcaacagaagccctcaagacctttgaggaggcctagaagagtcccataattcaatgcagttcctctcgctcatctttgcctcctgctcctcaaccacccccttgcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcac

SEQ ID NO: 178700 - DNA, 784 bp, Homo sapiens
  Payload ID: 15214
  Gene Symbol: S100A1
  Gene Name: S100 calcium binding protein A1
  ENST ID: ENST00000368698
  CDS Start-End: 148-591
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcacc

SEQ ID NO: 178701 - DNA, 236 bp, Homo sapiens
  Payload ID: 15214
  Gene Symbol: S100A1
  Gene Name: S100 calcium binding protein A1
  ENST ID: ENST00000436839
  CDS Start-End: 133-236
agaacctgctcccacctcaggcccaggccaaccggagccctcaagtccctgccaaggccccctctgtctcccaggtgttgggaagggtcccagccctcccctgcctcgcctcctgtggggtgcactgctgcaatgggctctgagctggagacggcgatggagaccctcatcaacgtgttccacgcccactcgggcaaagagggggacaagtacaagctgagcaagaaggagctgaa

SEQ ID NO: 178702 - DNA, 616 bp, Homo sapiens
  Payload ID: 15215
  Gene Symbol: S100A10
  Gene Name: S100 calcium binding protein A10
  Uniprot ID: P60903
  ENST ID: ENST00000368809
  CDS Start-End: 78-371
actccctgaaggaaaaggagaactgtgccatctcagagggcattttccaagaggaagcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 178703 - DNA, 1202 bp, Homo sapiens
  Payload ID: 15215
  Gene Symbol: S100A10
  Gene Name: S100 calcium binding protein A10
  Uniprot ID: P60903
  ENST ID: ENST00000368811
  CDS Start-End: 661-954
ccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 178704 - DNA, 594 bp, Homo sapiens
  Payload ID: 15216
  Gene Symbol: S100A11
  Gene Name: S100 calcium binding protein A11
  Uniprot ID: P31949
  ENST ID: ENST00000271638
  CDS Start-End: 121-438
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaa

SEQ ID NO: 178705 - DNA, 518 bp, Homo sapiens
  Payload ID: 15217
  Gene Symbol: S100A12
  Gene Name: S100 calcium binding protein A12
  Uniprot ID: P80511
  ENST ID: ENST00000368737
  CDS Start-End: 119-397
aagatgaagcctgaactgattataaaaccttccttggctcagtgcccttcaccactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatgctaatcaagatgaacaggtcgactttcaagaattcatatccctggtagccattgcgctgaaggctgcccattaccacacccacaaagagtaggtagctctctgaaggctttttacccagcaatgtcctcaatgagggtcttttctttccctcaccaaaacccagccttgcccgtggggagtaagagttaataaacacactcacgaaaagttct

SEQ ID NO: 178706 - DNA, 514 bp, Homo sapiens
  Payload ID: 15218
  Gene Symbol: S100A13
  Gene Name: S100 calcium binding protein A13
  Uniprot ID: Q99584
  ENST ID: ENST00000339556
  CDS Start-End: 122-418
gatgtcttaccccaagctgggccttgcagtacctgtggctggctgtgctggttgagcccggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaa

SEQ ID NO: 178707 - DNA, 547 bp, Homo sapiens
  Payload ID: 15218
  Gene Symbol: S100A13
  Gene Name: S100 calcium binding protein A13
  Uniprot ID: Q99584
  ENST ID: ENST00000392622
  CDS Start-End: 160-456
gctgggaggagcggttagagtgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 178708 - DNA, 579 bp, Homo sapiens
  Payload ID: 15218
  Gene Symbol: S100A13
  Gene Name: S100 calcium binding protein A13
  Uniprot ID: Q99584
  ENST ID: ENST00000392623
  CDS Start-End: 192-488
gtactaaacccgtcctggagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaac

SEQ ID NO: 178709 - DNA, 686 bp, Homo sapiens
  Payload ID: 15218
  Gene Symbol: S100A13
  Gene Name: S100 calcium binding protein A13
  Uniprot ID: Q99584
  ENST ID: ENST00000440685
  CDS Start-End: 297-593
aggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacac

SEQ ID NO: 178710 - DNA, 1058 bp, Homo sapiens
  Payload ID: 15219
  Gene Symbol: S100A14
  Gene Name: S100 calcium binding protein A14
  Uniprot ID: Q9HCY8
  ENST ID: ENST00000344616
  CDS Start-End: 117-431
gctggctcctcctgtcttgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtg

SEQ ID NO: 178711 - DNA, 1080 bp, Homo sapiens
  Payload ID: 15219
  Gene Symbol: S100A14
  Gene Name: S100 calcium binding protein A14
  Uniprot ID: Q9HCY8
  ENST ID: ENST00000368701
  CDS Start-End: 136-450
gaaacccaaggcttttcacccaaatatactgcctgctgtccagagggcacacttaggatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 178712 - DNA, 1218 bp, Homo sapiens
  Payload ID: 15219
  Gene Symbol: S100A14
  Gene Name: S100 calcium binding protein A14
  Uniprot ID: Q9HCY8
  ENST ID: ENST00000368702
  CDS Start-End: 274-588
ctctgggccgctgaggggagctgaagggaggtcaggcaaacactcactcaatctgcctccctccatcaggctgcccttctctggcttcctcctgatccaagttctctacattcatctctctgcctccaggactggtataagagctgagctcaggtgagctggctcctcctgtcttgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 178713 - DNA, 1025 bp, Homo sapiens
  Payload ID: 15219
  Gene Symbol: S100A14
  Gene Name: S100 calcium binding protein A14
  Uniprot ID: Q9HCY8
  ENST ID: ENST00000476873
  CDS Start-End: 81-395
agatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 178714 - DNA, 946 bp, Homo sapiens
  Payload ID: 15220
  Gene Symbol: S100A16
  Gene Name: S100 calcium binding protein A16
  Uniprot ID: Q96FQ6
  ENST ID: ENST00000368703
  CDS Start-End: 76-387
ctctgttccccttttcctgccaccttcttctccagggaccagaaacaaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgctt

SEQ ID NO: 178715 - DNA, 1146 bp, Homo sapiens
  Payload ID: 15220
  Gene Symbol: S100A16
  Gene Name: S100 calcium binding protein A16
  Uniprot ID: Q96FQ6
  ENST ID: ENST00000368704
  CDS Start-End: 187-498
aatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaa

SEQ ID NO: 178716 - DNA, 956 bp, Homo sapiens
  Payload ID: 15220
  Gene Symbol: S100A16
  Gene Name: S100 calcium binding protein A16
  Uniprot ID: Q96FQ6
  ENST ID: ENST00000368705
  CDS Start-End: 473-784
gagtaggaatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggtgagggtgactggagcacattcctgggcttgggggtgggaagggagtctgatttgcctggggttgatgtgggggggttttgggcatgggccgtgactcacagagtagatccagatccgcctgctcccctcatatcctgttattcagaaggctgtatccgcttagaaagtgtcttttgtcctggggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctaga

SEQ ID NO: 178717 - DNA, 1118 bp, Homo sapiens
  Payload ID: 15220
  Gene Symbol: S100A16
  Gene Name: S100 calcium binding protein A16
  Uniprot ID: Q96FQ6
  ENST ID: ENST00000368706
  CDS Start-End: 159-470
ggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaa

SEQ ID NO: 178718 - DNA, 556 bp, Homo sapiens
  Payload ID: 15221
  Gene Symbol: S100A2
  Gene Name: S100 calcium binding protein A2
  ENST ID: ENST00000368707
  CDS Start-End: 51-338
gctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtggggcattccagagaaccatgtgctgtgagggccttccgagtccatctgtttaatcctgtcattggagacttgagaaaccagagcccagaagggaaaagtgattgtcccaagatcacacagcactggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctg

SEQ ID NO: 178719 - DNA, 998 bp, Homo sapiens
  Payload ID: 15221
  Gene Symbol: S100A2
  Gene Name: S100 calcium binding protein A2
  Uniprot ID: P29034
  ENST ID: ENST00000368708
  CDS Start-End: 374-667
tggcaccagtctccaggccccagagcaggggttgcctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaa

SEQ ID NO: 178720 - DNA, 457 bp, Homo sapiens
  Payload ID: 15221
  Gene Symbol: S100A2
  Gene Name: S100 calcium binding protein A2
  Uniprot ID: P29034
  ENST ID: ENST00000368709
  CDS Start-End: 68-361
ggaggagggtgtgccgctgagtcactgcctgggcatctgggcctggaacctcggccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgata

SEQ ID NO: 178721 - DNA, 453 bp, Homo sapiens
  Payload ID: 15221
  Gene Symbol: S100A2
  Gene Name: S100 calcium binding protein A2
  Uniprot ID: P29034
  ENST ID: ENST00000368710
  CDS Start-End: 61-354
gtgagctcaccatgtgggggtgaggctgagagaaaacaagtacacagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 178722 - DNA, 752 bp, Homo sapiens
  Payload ID: 15221
  Gene Symbol: S100A2
  Gene Name: S100 calcium binding protein A2
  Uniprot ID: P29034
  ENST ID: ENST00000487430
  CDS Start-End: 360-653
gcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctggcacctctgcagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 178723 - DNA, 697 bp, Homo sapiens
  Payload ID: 15221
  Gene Symbol: S100A2
  Gene Name: S100 calcium binding protein A2
  ENST ID: ENST00000497140
  CDS Start-End: 404-598
ctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 178724 - DNA, 579 bp, Homo sapiens
  Payload ID: 15222
  Gene Symbol: S100A3
  Gene Name: S100 calcium binding protein A3
  Uniprot ID: P33764
  ENST ID: ENST00000368712
  CDS Start-End: 105-410
aaatggctcaccaaggttgcacagctggcgacaggcagagaggatcccacaagtttttcttctgggtgcagcttcctcgagttcagggcaggaggcaggtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggat

SEQ ID NO: 178725 - DNA, 856 bp, Homo sapiens
  Payload ID: 15222
  Gene Symbol: S100A3
  Gene Name: S100 calcium binding protein A3
  Uniprot ID: P33764
  ENST ID: ENST00000368713
  CDS Start-End: 198-503
ggggaggtgagcaattccaggaagggcttcccctccaatagaacagagtatccctatacagaacctccctgctcaaaacccccaggggtcgggagggtaacctcaggggaggccagtctcagattggtaaacacccgaactggtcaactctcaagagaccatctggttcaggttcctgactgggccagcgagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcatcagc

SEQ ID NO: 178726 - DNA, 566 bp, Homo sapiens
  Payload ID: 15223
  Gene Symbol: S100A4
  Gene Name: S100 calcium binding protein A4
  Uniprot ID: P26447
  ENST ID: ENST00000354332
  CDS Start-End: 115-420
ttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 178727 - DNA, 531 bp, Homo sapiens
  Payload ID: 15223
  Gene Symbol: S100A4
  Gene Name: S100 calcium binding protein A4
  Uniprot ID: P26447
  ENST ID: ENST00000368714
  CDS Start-End: 88-393
tcctttcttgggaggctacaaatagtgacgccctgtctctaagctcctacagctgaaacgccagcaccagtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 178728 - DNA, 573 bp, Homo sapiens
  Payload ID: 15223
  Gene Symbol: S100A4
  Gene Name: S100 calcium binding protein A4
  Uniprot ID: P26447
  ENST ID: ENST00000368715
  CDS Start-End: 122-427
ggccctgggagtttgctgcccgaatctccagagcttgcgcagcggatcttgcaaatgttcactgcccagagcatgtgttccccactgtgcacaccctcccagccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 178729 - DNA, 600 bp, Homo sapiens
  Payload ID: 15223
  Gene Symbol: S100A4
  Gene Name: S100 calcium binding protein A4
  Uniprot ID: P26447
  ENST ID: ENST00000368716
  CDS Start-End: 149-454
agtatccgctctcccctgtcccctgctatgggcagggcctggctggggtataaataggtcagacctctgggccgtccccattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctga

SEQ ID NO: 178730 - DNA, 506 bp, Homo sapiens
  Payload ID: 15224
  Gene Symbol: S100A5
  Gene Name: S100 calcium binding protein A5
  Uniprot ID: P33763
  ENST ID: ENST00000368717
  CDS Start-End: 89-367
cagccccctctcagccctggactctctctttgccctgtccccgactttaataatgggacactcctcgatatcagagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgca

SEQ ID NO: 178731 - DNA, 710 bp, Homo sapiens
  Payload ID: 15224
  Gene Symbol: S100A5
  Gene Name: S100 calcium binding protein A5
  Uniprot ID: P33763
  ENST ID: ENST00000368718
  CDS Start-End: 283-561
tcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaagggacagagatcagggaaataaaggcagaaggcagtgagagggaggctatgcctgctgcttggattctctgggctcactcccacagtgagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctggga

SEQ ID NO: 178732 - DNA, 665 bp, Homo sapiens
  Payload ID: 15225
  Gene Symbol: S100A6
  Gene Name: S100 calcium binding protein A6
  Uniprot ID: P06703
  ENST ID: ENST00000368719
  CDS Start-End: 296-568
ctcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 178733 - DNA, 673 bp, Homo sapiens
  Payload ID: 15225
  Gene Symbol: S100A6
  Gene Name: S100 calcium binding protein A6
  Uniprot ID: P06703
  ENST ID: ENST00000368720
  CDS Start-End: 304-576
gagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgagccctgggtactttccagggccagctgccctcacgctgggggtccagccatcccctgcccagttcagccgctggatccagactggggccatctgtggcgctcccccgctggagggatagtcaggagcagcagtgctgtgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 178734 - DNA, 479 bp, Homo sapiens
  Payload ID: 15225
  Gene Symbol: S100A6
  Gene Name: S100 calcium binding protein A6
  ENST ID: ENST00000462776
  CDS Start-End: 225-479
atcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaat

SEQ ID NO: 178735 - DNA, 673 bp, Homo sapiens
  Payload ID: 15225
  Gene Symbol: S100A6
  Gene Name: S100 calcium binding protein A6
  Uniprot ID: P06703
  ENST ID: ENST00000496817
  CDS Start-End: 304-576
ccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 178736 - DNA, 442 bp, Homo sapiens
  Payload ID: 15226
  Gene Symbol: S100A7
  Gene Name: S100 calcium binding protein A7
  Uniprot ID: P31151
  ENST ID: ENST00000368722
  CDS Start-End: 75-380
ggcttggggtgcaggccagcccagactgactactggctgaaagatctgctttgggaagctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 178737 - DNA, 479 bp, Homo sapiens
  Payload ID: 15226
  Gene Symbol: S100A7
  Gene Name: S100 calcium binding protein A7
  Uniprot ID: P31151
  ENST ID: ENST00000368723
  CDS Start-End: 112-417
tgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 178738 - DNA, 491 bp, Homo sapiens
  Payload ID: 15227
  Gene Symbol: S100A7A
  Gene Name: S100 calcium binding protein A7A
  Uniprot ID: Q86SG5
  ENST ID: ENST00000329256
  CDS Start-End: 140-445
caagttccttctgctccatcttagggctgtttttactctgtcctcagccctccttctaacacccccacatagagaccttaattcaaactaaggtaagaaatgattgtctttatttcctgaaggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtg

SEQ ID NO: 178739 - DNA, 440 bp, Homo sapiens
  Payload ID: 15227
  Gene Symbol: S100A7A
  Gene Name: S100 calcium binding protein A7A
  Uniprot ID: Q86SG5
  ENST ID: ENST00000368728
  CDS Start-End: 74-379
gcttggggtgcagggcagcccaggctggctactggctggaagatctgctttggaaagctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccaga

SEQ ID NO: 178740 - DNA, 4279 bp, Homo sapiens
  Payload ID: 15227
  Gene Symbol: S100A7A
  Gene Name: S100 calcium binding protein A7A
  Uniprot ID: Q86SG5
  ENST ID: ENST00000368729
  CDS Start-End: 58-363
atctcactcatccttctactcgtgacacttcccagttctggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtc

SEQ ID NO: 178741 - DNA, 339 bp, Homo sapiens
  Payload ID: 15228
  Gene Symbol: S100A7L2
  Gene Name: S100 calcium binding protein A7-like 2
  Uniprot ID: Q5SY68
  ENST ID: ENST00000368725
  CDS Start-End: 1-339
atgcttcccagctctggctttttgaaagcaaagatgaatatccctctaggtgagaaagtcatgttggacatagtcgcgatgtttcgccaatacagtggagatgatggtaggatggacatgccaggtctggtgaacttgatgaaggagaacttccccaacttcctcagtggctgtgaaaaaagcgacatggattacttgtccaatgcccttgagaaaaaagatgataataaggataagaaggttaattattctgagtttctttccttgctgggggatataaccatagaccaccacaagataatgcatggagtggcaccctgttccgggggaagccagtga

SEQ ID NO: 178742 - DNA, 495 bp, Homo sapiens
  Payload ID: 15229
  Gene Symbol: S100A8
  Gene Name: S100 calcium binding protein A8
  Uniprot ID: P05109
  ENST ID: ENST00000368732
  CDS Start-End: 143-424
gagcagccttcctgagagaggagagagaaagctcagggaggtctggagcaaagatactcctggaggtggggagtgaggcagggataaggaaggagagtatcctccagcaccttccagtgggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 178743 - DNA, 523 bp, Homo sapiens
  Payload ID: 15229
  Gene Symbol: S100A8
  Gene Name: S100 calcium binding protein A8
  Uniprot ID: P05109
  ENST ID: ENST00000368733
  CDS Start-End: 171-452
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 178744 - DNA, 577 bp, Homo sapiens
  Payload ID: 15230
  Gene Symbol: S100A9
  Gene Name: S100 calcium binding protein A9
  Uniprot ID: P06702
  ENST ID: ENST00000368738
  CDS Start-End: 44-388
aaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtca

SEQ ID NO: 178745 - DNA, 877 bp, Homo sapiens
  Payload ID: 15231
  Gene Symbol: S100B
  Gene Name: S100 calcium binding protein B
  Uniprot ID: P04271
  ENST ID: ENST00000291700
  CDS Start-End: 198-476
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagca

SEQ ID NO: 178746 - DNA, 971 bp, Homo sapiens
  Payload ID: 15231
  Gene Symbol: S100B
  Gene Name: S100 calcium binding protein B
  ENST ID: ENST00000367071
  CDS Start-End: 198-482
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagagagatggagtctccctatgttgcccaggctggtctcaaacttcctgtgctcaagttatcctcctgccttagcttcccaaagtgctgggattacaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagca

SEQ ID NO: 178747 - DNA, 839 bp, Homo sapiens
  Payload ID: 15231
  Gene Symbol: S100B
  Gene Name: S100 calcium binding protein B
  Uniprot ID: P04271
  ENST ID: ENST00000397648
  CDS Start-End: 479-757
ttgctcctagtcactgtctcactttcagattgattttaacagcttgcagttgatggtttgctcacctgcactctaccacctcatcttggagccttgcaggaacagagagggaccctgtggggattaattcaggggaaattaatccctgaattcccttgctgctctgcctctgtatttttgccagtttccctgttggcccaacccagccagaattcagagggcatgggaatatatccccgtggcccacacggacagagaaggcaggcccacagctgtctaagaggccggtggaaggattatgataaaagtgcaaattcccagaatgcccctccaggccatgcctgctgctctgagcttgaaaagagtgccaaggccattccatcccccttgtctgggttgaggtctgtattgataacatatgaaatgttttaggatgaggtatagatgagaaggcaactttcctttgcgagcccctaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtagga

SEQ ID NO: 178748 - DNA, 455 bp, Homo sapiens
  Payload ID: 15232
  Gene Symbol: S100G
  Gene Name: S100 calcium binding protein G
  Uniprot ID: P29377
  ENST ID: ENST00000380200
  CDS Start-End: 55-294
aaactcctctttgattcttctagctgtttcactattgggcaaccagacaccagaatgagtactaaaaagtctcctgaggaactgaagaggatttttgaaaaatatgcagccaaagaaggtgatccagaccagttgtcaaaggatgaactgaagctattgattcaggctgaattccccagtttactcaaaggtccaaacaccctagatgatctctttcaagaactggacaagaatggagatggagaagttagttttgaagaattccaagtattagtaaaaaagatatcccagtgaaggagaaaacaaaatagaaccctgagcactggaggaagagcgcctgtgctgtggtcttatcctatgtggaatcccccaaagtctctggtttaattctttgcaattataataacctggctgtgaggttcagttattattaataaagaaattattagacatac

SEQ ID NO: 178749 - DNA, 1279 bp, Homo sapiens
  Payload ID: 15233
  Gene Symbol: S100P
  Gene Name: S100 calcium binding protein P
  Uniprot ID: P25815
  ENST ID: ENST00000296370
  CDS Start-End: 865-1152
cacctagaaggaaggagagctgctcagagaggccccagggaatctgactcaacaggccctaccaggctctcctcttggtctgtgagcatccagccttacttttgtatccaatcatatttccatacttcgctgaactgtgtttatggatagtttccaccagatctttggatcttcatcttgaaggctgccgtgccacataagctatgatcaaatacatctgttatgctcttctcctattcatctgccttctgcccgttgattttcagcaaactcccagaggatgaaggggagttttctgtttggccccacaggggaggagcgagcgagattgacgtggaagctgggcctctgaaggacacagagtgctctaagaaagggacgatggggcagatccatgttcacaaacacgcccatgtgaattcactctcagatgtctcctcgtgtcagcacgctgggtgccagcacgctctgatattgacacaaagggccacggagtcaccactcactccacacacactcaccccgtgcccacttacccagggagggccaggaatgaggatgccactgtggctcagtgatggcgccgagacacaggtgaacactgtaaaatgtggatgcctggaggcagcccacaccctgggccttggctgggggaaaggttccagaaacgtcatcacaacgatgcatttcatcagaactgagcacatgaatggggaggggcaggacttcctgaatgtcccaaccccactgtcccaccctctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatagtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatg

SEQ ID NO: 178750 - DNA, 1468 bp, Homo sapiens
  Payload ID: 15234
  Gene Symbol: S100Z
  Gene Name: S100 calcium binding protein Z
  Uniprot ID: Q8WXG8
  ENST ID: ENST00000317593
  CDS Start-End: 233-532
cagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcattaaaaaagtaatataagtttattgtagggggaaataatcaaatgtaatctcattacccagatataatcactgttaacttcttcattcgaattttccctaggtccatgtatctatatatctatggttcataaaaatgagattacaccaaaaaatatcttttgttatctatatagttccagcttaataaatatacaactgtattattatttttgtctgaatagtattttcattgatatatcacaatatatttactccaattccctattgcatatagattatttctaatttttctattaataatactaagggagcttttaagtcaatacatctgaatcttgaataaaattcttgttccttctctttggatgggtattcagactcttaattttacaaatgaagaaataaagtcccagaaggtaacagagatagaactaggcacgattttctattcttctttccttcctttctttgtgagagttaacgattatttaaaagtattcataattttctgataataaaagtaagacatggcattatgacactggatattcaaaaaccacgatgtccttttacttgaagattttaaaaggaaatgattacaataaatacccagagtcaacaatta

SEQ ID NO: 178751 - DNA, 1017 bp, Homo sapiens
  Payload ID: 15234
  Gene Symbol: S100Z
  Gene Name: S100 calcium binding protein Z
  Uniprot ID: Q8WXG8
  ENST ID: ENST00000513010
  CDS Start-End: 331-630
gagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggtaagtaataagctcatctaaaggcagaaatatatccaaagttatgtacttaatgttcatttataccgttcagatctatagacccagtaatgtcatttatagctataatatccagtgcatatattaataattaattgctactattgaattatgtgccccttaaaatattgactttatgtagatattctaaatctcatatgccctacttgaaacttgcctgtattattaagaggctatatgcatctttttggtttgtcaaaacgagggcattacaaaaatttagctactttcaaatgagacttgaatttggcaaatttctaagatggacattcatatccttaaattgtattttgaacttcttaccctattaaaaaaaattaactgg

SEQ ID NO: 178752 - DNA, 671 bp, Homo sapiens
  Payload ID: 15234
  Gene Symbol: S100Z
  Gene Name: S100 calcium binding protein Z
  Uniprot ID: Q8WXG8
  ENST ID: ENST00000613039
  CDS Start-End: 60-359
aagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcatt

SEQ ID NO: 178753 - DNA, 4322 bp, Homo sapiens
  Payload ID: 15235
  Gene Symbol: S100PBP
  Gene Name: S100P binding protein
  Uniprot ID: Q96BU1
  ENST ID: ENST00000373475
  CDS Start-End: 255-1481
actgctggtttgccctccccctggtgttggcccggctgactcggggtaggggaggtcggggagggggcgataaaatggcgcagggggcggagtgaggcgcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctcttttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtactgggtagaatctggagttttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgacata

SEQ ID NO: 178754 - DNA, 3320 bp, Homo sapiens
  Payload ID: 15235
  Gene Symbol: S100PBP
  Gene Name: S100P binding protein
  Uniprot ID: Q96BU1
  ENST ID: ENST00000373476
  CDS Start-End: 278-1504
gatgagacgggaaaaggtggagccagtgggcacggtgggcggtgcggagggcggggctgaggcgcctgagcggggcacaaccctcctagaggcgggacggtttcctgccaatcactgctggtttgccctccccctggtgttggcccggctgactcggggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctcttttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtc

SEQ ID NO: 178755 - DNA, 706 bp, Homo sapiens
  Payload ID: 15235
  Gene Symbol: S100PBP
  Gene Name: S100P binding protein
  ENST ID: ENST00000482212
  CDS Start-End: 268-706
gggagggacgagggggtcggcgttacccggcttggagggggatgggggcgcctgttgcttctccagggggttgcgcacgccgtccgccccttggagggattgggaggcccacgccctgctgcgagaagggcgcgttctagctcctgaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaa

SEQ ID NO: 178756 - DNA, 429 bp, Homo sapiens
  Payload ID: 15235
  Gene Symbol: S100PBP
  Gene Name: S100P binding protein
  ENST ID: ENST00000529027
  CDS Start-End: 306-429
tgctggtttgccctccccctggtgttggcccggctgactcggggtaggggaggtcggggagggggcgataaaatggcgcagggggcggagtgaggcgcagtcgttcgcccaggctttggcccggcttccggagtgtgccacatttatgttcacgatctcatttaattcttgccacaaccctatcaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgt

SEQ ID NO: 178757 - DNA, 573 bp, Homo sapiens
  Payload ID: 15235
  Gene Symbol: S100PBP
  Gene Name: S100P binding protein
  ENST ID: ENST00000526230
  CDS Start-End: 213-573
gcagtcgttcgcccaggctttggcccggcttccggaggaaggtgggagtcaatcattttgacaagtctcctgaaaggaacagctagcaggaactgaaacctttttccatttggtctcgtggcaaaggcagagattgctccagcagctccacacagtatggaagacagttatttaccttcttgtgttctcgaattttgttttatttcaaaaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagta

SEQ ID NO: 178758 - DNA, 551 bp, Homo sapiens
  Payload ID: 15235
  Gene Symbol: S100PBP
  Gene Name: S100P binding protein
  ENST ID: ENST00000530552
  CDS Start-End: 536-551
cttagacattgcctagcaccccttttccatccctttcccattttgtaaatgaggaaacaagtctaaatggtcaagtggcatacccaagttattggagctggctagtgatacaaccaggactacaccccaggtctttggactcccatgccagtattcatcctactaaagtagatgatagtcttaagaaagtacaaattgttgggaggaacaaaactagtttgcttagttgcataatttttttttctttgaagatttctttggtgtgcttgactcagaaaatccaactttctggtattacaaaaaaaatcaagattaaaattaatacatcgagcaccttaaagcataatacagttgactttgtaattagcagagttgaaagtgatgagaagatcctctaattttctttttgcctgcaggaaggtgggagtcaatcattttgacaagtctcctgaaaggaacagctagcaggaactgaaacctttttccatttggtctcgtggcaaaggcagagattgctccagcagctccacacaaaatgatgtgctcacggg

SEQ ID NO: 178759 - DNA, 725 bp, Homo sapiens
  Payload ID: 15235
  Gene Symbol: S100PBP
  Gene Name: S100P binding protein
  ENST ID: ENST00000530710
  CDS Start-End: 336-725
ctctctttccctttaaagctcccagtatagcatcttccagtacttacttgaaccgtaatgggtcatttttaacgtctgatccccttcagacaagctctggcaggcccttgacgtatccccagcgactaagcaccacgtctggcacttaataggggggtggaatgggagtcctggattcaaagtttggctccaacacaagacaactggacgcaagaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatact

SEQ ID NO: 178760 - DNA, 551 bp, Homo sapiens
  Payload ID: 15235
  Gene Symbol: S100PBP
  Gene Name: S100P binding protein
  ENST ID: ENST00000531256
  CDS Start-End: 38-551
agtcgttcgcccaggctttggcccggcttccggagaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactg

SEQ ID NO: 178761 - DNA, 743 bp, Homo sapiens
  Payload ID: 15236
  Gene Symbol: SAA2-SAA4
  Gene Name: SAA2-SAA4 readthrough
  ENST ID: ENST00000524555
  CDS Start-End: 38-664
agggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactgctatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcact

SEQ ID NO: 178762 - DNA, 3723 bp, Homo sapiens
  Payload ID: 15237
  Gene Symbol: SACM1L
  Gene Name: SAC1 suppressor of actin mutations 1-like (yeast)
  Uniprot ID: Q9NTJ5
  ENST ID: ENST00000389061
  CDS Start-End: 205-1968
ggcatctctcgcgtgctcttgcttgcgcactaatttgtcctccaccgcctcccgttcaggccggctctcctgcggggcggggaaaggggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttctattattggtatcattc

SEQ ID NO: 178763 - DNA, 4661 bp, Homo sapiens
  Payload ID: 15237
  Gene Symbol: SACM1L
  Gene Name: SAC1 suppressor of actin mutations 1-like (yeast)
  ENST ID: ENST00000455997
  CDS Start-End: 1480-2343
ccccaaaacgcgccccaccaatccgcagcggcttcgtcacggcgctcttcgtcgcactccaacccgccgcgtcggcggcatctctcgcgtgctcttgcttgcgcactaatttgtcctccaccgcctcccgttcaggccggctctcctgcggggcggggaaaggggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgtgagtcccacgggccagaggcctgaggcgcggcgggcggggcggcaggtgcgggccctggcctcggggagggcttctgagtcccggattgcagatagggtgtgggagctcctcgcatttaccggttttcctcagccggcgcggcctctcctaggcctcgcccgagtagccataggccgggaaccagcggctcgccggcctttctccaccgtgctcggccccagcgcccacggctgaagagagaagctgccgactggcccccaccgagccggggtcggcgttatgatgcggcccttcagggcacgcttgtccccactttctatgcagagctaccgactaaatttatctgtatgacttaacagagaaaaagagttttctcttacttaacggacctacagcagcaatttagagtctacgcacaaatcaacaaatctttgttttgcttacagcctatctgggtaccgaagcctgcctgccccctcttcagtgtgcagaaaaaatttaaagtacagtcagtagtcttaaggtcctgaaggagtttactttggtttaaattttaaacagctccagcctaaagcaggttcttaagtcagtgtcgacagccagaggctaatctcggtaattttggtactgcaaattgacttttcggtaaatccaagttcttgagtctttgatacagaggctgtggttgttaagagttataaaataggtgtttttaagggttttggtttgtcttggattaaaaacaacatgtgtttatttcccttagtgttacccattagcatccacacttttcttgtctgtgaataattttgttgtactcacttcgtgtttaatgctttacccctaggctgtttgaaaatctggtggccacagcctgggaatatctggcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttc

SEQ ID NO: 178764 - DNA, 2164 bp, Homo sapiens
  Payload ID: 15237
  Gene Symbol: SACM1L
  Gene Name: SAC1 suppressor of actin mutations 1-like (yeast)
  ENST ID: ENST00000418611
  CDS Start-End: 575-2029
actccaacccgccgcgtcggcggcatctctcgcgtgctcttgcttgcgcactaatttgtcctccaccgcctcccgttcaggccggctctcctgcggggcggggaaaggggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgctgtttgaaaatctggtggccacagcctgggaatatctggcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgca

SEQ ID NO: 178765 - DNA, 2013 bp, Homo sapiens
  Payload ID: 15237
  Gene Symbol: SACM1L
  Gene Name: SAC1 suppressor of actin mutations 1-like (yeast)
  ENST ID: ENST00000441228
  CDS Start-End: 112-327
aagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctga

SEQ ID NO: 178766 - DNA, 542 bp, Homo sapiens
  Payload ID: 15237
  Gene Symbol: SACM1L
  Gene Name: SAC1 suppressor of actin mutations 1-like (yeast)
  ENST ID: ENST00000438671
  CDS Start-End: 205-542
gaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgctgtttgaaaatctggtggccacagcctgggaatatctggcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaag

SEQ ID NO: 178767 - DNA, 678 bp, Homo sapiens
  Payload ID: 15237
  Gene Symbol: SACM1L
  Gene Name: SAC1 suppressor of actin mutations 1-like (yeast)
  ENST ID: ENST00000433336
  CDS Start-End: 117-678
ggatcagtctgtggtaaaggtttaaggtcttctcaggactcttttcagcatgcatcttgcctggttatattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagatttacaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcata

SEQ ID NO: 178768 - DNA, 1566 bp, Homo sapiens
  Payload ID: 15238
  Gene Symbol: SAC3D1
  Gene Name: SAC3 domain containing 1
  ENST ID: ENST00000398846
  CDS Start-End: 390-1466
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagacaggttcagccccgccccgacccgccgctccccaccccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggt

SEQ ID NO: 178769 - DNA, 1362 bp, Homo sapiens
  Payload ID: 15238
  Gene Symbol: SAC3D1
  Gene Name: SAC3 domain containing 1
  ENST ID: ENST00000531072
  CDS Start-End: 214-1290
accacaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactggccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttcca

SEQ ID NO: 178770 - DNA, 1366 bp, Homo sapiens
  Payload ID: 15238
  Gene Symbol: SAC3D1
  Gene Name: SAC3 domain containing 1
  ENST ID: ENST00000529996
  CDS Start-End: 1-720
tgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctggagatgggatctcgcatgttgccactcgaattcctgggctcaagtgatcctcctgccccaccctcccaagtagccgggtgtggccatcatgcccagtgaatggtttatttttgtccacactgttcctctgaagaaggcatggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggta

SEQ ID NO: 178771 - DNA, 1315 bp, Homo sapiens
  Payload ID: 15238
  Gene Symbol: SAC3D1
  Gene Name: SAC3 domain containing 1
  Uniprot ID: A6NKF1
  ENST ID: ENST00000614106
  CDS Start-End: 1-1215
atggcgggaaggcgggcccagacaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggt

SEQ ID NO: 178772 - DNA, 2503 bp, Homo sapiens
  Payload ID: 15239
  Gene Symbol: SCCPDH
  Gene Name: saccharopine dehydrogenase (putative)
  Uniprot ID: Q8NBX0
  ENST ID: ENST00000366510
  CDS Start-End: 377-1666
cgcctccagcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaa

SEQ ID NO: 178773 - DNA, 15324 bp, Homo sapiens
  Payload ID: 15240
  Gene Symbol: SACS
  Gene Name: sacsin molecular chaperone
  Uniprot ID: Q9NZJ4
  ENST ID: ENST00000382292
  CDS Start-End: 275-14014
tatcctgagaacttccatgggtcgctggatcagcaggcaaccattatcagactggagagtcatactttaaggaatacaaatgcaacacacgacaatgtttcctgacatcagatgatgaatggacactgaagggaaaaacaggctttttttccacctggcaggaagagctgaacttggagtacacatttaaaggaagcacagagggaagacttaaacagaagaaagaagcgtactttcatggttttcacaaacaaatatcccaggagaagtgatcatggagaccaaggagaacaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcat

SEQ ID NO: 178774 - DNA, 15668 bp, Homo sapiens
  Payload ID: 15240
  Gene Symbol: SACS
  Gene Name: sacsin molecular chaperone
  Uniprot ID: Q9NZJ4
  ENST ID: ENST00000382298
  CDS Start-End: 616-14355
gactgcggcaggagccgcctggacccagtgcggctgcgggacagtcacgctgggaactgctgatggcactggaggaaaacaaaggccgagagaccctgatgcccacagcccccagatcacagaagtgaggccaagatgcccatgtcaccagagccagaagaaaggctcctaccaaagaatattttacatctgctgagatgagggtgagaaacaaaatccaagaatttctgcgacgttttccccaagaaccttcaaaaagaaatacagaaaattctcagatgaaaataaattgattttgctctgggggaaagccaaaaacctttagcgaatccacactgttttatcctgagaacttccatgggtcgctggatcagcaggcaaccattatcagactggagagtcatactttaaggaatacaaatgcaacacacgacaatgtttcctgacatcagatgatgaatggacactgaagggaaaaacaggctttttttccacctggcaggaagagctgaacttggagtacacatttaaaggaagcacagagggaagacttaaacagaagaaagaagcgtactttcatggttttcacaaacaaatatcccaggagaagtgatcatggagaccaaggagaacaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcatcgt

SEQ ID NO: 178775 - DNA, 15134 bp, Homo sapiens
  Payload ID: 15240
  Gene Symbol: SACS
  Gene Name: sacsin molecular chaperone
  Uniprot ID: Q9NZJ4
  ENST ID: ENST00000402364
  CDS Start-End: 2335-13824
ctgctcctcggccgccgcggcttcctctagcgtttcctcctcggcgcgggctgctgcgtacgggactgcgccatgcggatcccgccctcccggcccgcgcggggcctgtggacgcggtagggccggccgtgatcgggcgccggcgtcaggggcgggcgctaggggcgcctgccgcgccgcgatgtgggagaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcat

SEQ ID NO: 178776 - DNA, 1709 bp, Homo sapiens
  Payload ID: 15240
  Gene Symbol: SACS
  Gene Name: sacsin molecular chaperone
  ENST ID: ENST00000423156
  CDS Start-End: 1-1125
attgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatg

SEQ ID NO: 178777 - DNA, 2784 bp, Homo sapiens
  Payload ID: 15240
  Gene Symbol: SACS
  Gene Name: sacsin molecular chaperone
  ENST ID: ENST00000455470
  CDS Start-End: 1-2197
ggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaa

SEQ ID NO: 178778 - DNA, 3812 bp, Homo sapiens
  Payload ID: 15241
  Gene Symbol: SUN1
  Gene Name: Sad1 and UNC84 domain containing 1
  Uniprot ID: O94901
  ENST ID: ENST00000389574
  CDS Start-End: 133-2241
agagcgtcttctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 178779 - DNA, 978 bp, Homo sapiens
  Payload ID: 15241
  Gene Symbol: SUN1
  Gene Name: Sad1 and UNC84 domain containing 1
  Uniprot ID: O94901
  ENST ID: ENST00000403868
  CDS Start-End: 23-796
agtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgca

SEQ ID NO: 178780 - DNA, 3953 bp, Homo sapiens
  Payload ID: 15241
  Gene Symbol: SUN1
  Gene Name: Sad1 and UNC84 domain containing 1
  Uniprot ID: O94901
  ENST ID: ENST00000401592
  CDS Start-End: 25-2382
gcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 178781 - DNA, 4062 bp, Homo sapiens
  Payload ID: 15241
  Gene Symbol: SUN1
  Gene Name: Sad1 and UNC84 domain containing 1
  ENST ID: ENST00000405266
  CDS Start-End: 25-2493
gcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaag

SEQ ID NO: 178782 - DNA, 676 bp, Homo sapiens
  Payload ID: 15241
  Gene Symbol: SUN1
  Gene Name: Sad1 and UNC84 domain containing 1
  ENST ID: ENST00000435699
  CDS Start-End: 154-676
ttctcgggcctgggcggcgcagacgaggcctgaggcggcggcgcgaggcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccg

SEQ ID NO: 178783 - DNA, 3868 bp, Homo sapiens
  Payload ID: 15241
  Gene Symbol: SUN1
  Gene Name: Sad1 and UNC84 domain containing 1
  Uniprot ID: O94901
  ENST ID: ENST00000425407
  CDS Start-End: 171-2279
tatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 178784 - DNA, 513 bp, Homo sapiens
  Payload ID: 15241
  Gene Symbol: SUN1
  Gene Name: Sad1 and UNC84 domain containing 1
  ENST ID: ENST00000450881
  CDS Start-End: 1-513
agttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctgggggaaggcagcctctggagtgttctggtggctggggattggatggtaccagtttgttactttgatttcttggctgaatgtgtttcttcttaccaggtgccttcgaaacatctgcaagtttttagtcttgctcatccca

SEQ ID NO: 178785 - DNA, 540 bp, Homo sapiens
  Payload ID: 15241
  Gene Symbol: SUN1
  Gene Name: Sad1 and UNC84 domain containing 1
  ENST ID: ENST00000421580
  CDS Start-End: 201-540
aatatactcaacactttctaacctaaaaaatatcctgttttttggtgaggaaaaaagtgtaaatagtgccttaagcttttttgttattcaccctgcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcct

SEQ ID NO: 178786 - DNA, 633 bp, Homo sapiens
  Payload ID: 15241
  Gene Symbol: SUN1
  Gene Name: Sad1 and UNC84 domain containing 1
  ENST ID: ENST00000424128
  CDS Start-End: 368-633
gcgcaggtgaagacgcccggagaccctggcggtcgtggcgcagggggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccag

SEQ ID NO: 178787 - DNA, 1309 bp, Homo sapiens
  Payload ID: 15241
  Gene Symbol: SUN1
  Gene Name: Sad1 and UNC84 domain containing 1
  Uniprot ID: O94901
  ENST ID: ENST00000457378
  CDS Start-End: 237-1073
agagcgtcttctcgggcctgggcggcgcagacgaggcctgaggcggcggcgcgaggcagggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgcacacctttatttttataaaacggcacagatgttcacacatactgaaggagtggct

SEQ ID NO: 178788 - DNA, 537 bp, Homo sapiens
  Payload ID: 15241
  Gene Symbol: SUN1
  Gene Name: Sad1 and UNC84 domain containing 1
  ENST ID: ENST00000440380
  CDS Start-End: 272-537
agacgaggcctgaggcggcggcgcgaggcagggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccag

SEQ ID NO: 178789 - DNA, 563 bp, Homo sapiens
  Payload ID: 15241
  Gene Symbol: SUN1
  Gene Name: Sad1 and UNC84 domain containing 1
  ENST ID: ENST00000457598
  CDS Start-End: 208-563
agagcaggcctgcgcacctcaggagcccaggcatggtgtataggtggagggtagcctacattggatccaggccaaggccctgtcctgtgccgggctcctctgcgttttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacgg

SEQ ID NO: 178790 - DNA, 2975 bp, Homo sapiens
  Payload ID: 15241
  Gene Symbol: SUN1
  Gene Name: Sad1 and UNC84 domain containing 1
  ENST ID: ENST00000457861
  CDS Start-End: 1-1283
ggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccggg

SEQ ID NO: 178791 - DNA, 3474 bp, Homo sapiens
  Payload ID: 15241
  Gene Symbol: SUN1
  Gene Name: Sad1 and UNC84 domain containing 1
  ENST ID: ENST00000433212
  CDS Start-End: 1-1903
atcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 178792 - DNA, 3701 bp, Homo sapiens
  Payload ID: 15241
  Gene Symbol: SUN1
  Gene Name: Sad1 and UNC84 domain containing 1
  ENST ID: ENST00000429178
  CDS Start-End: 1-2133
ggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 178793 - DNA, 626 bp, Homo sapiens
  Payload ID: 15241
  Gene Symbol: SUN1
  Gene Name: Sad1 and UNC84 domain containing 1
  ENST ID: ENST00000439679
  CDS Start-End: 220-626
ggggggacgcggggtcgcggcctgggcgccctcagcgcgggctgcgccagggcctcctgggccaacggctgccgcccccgcccgtcccgcgccccgcagctaccccggcccgcgcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattgga

SEQ ID NO: 178794 - DNA, 3717 bp, Homo sapiens
  Payload ID: 15241
  Gene Symbol: SUN1
  Gene Name: Sad1 and UNC84 domain containing 1
  Uniprot ID: O94901
  ENST ID: ENST00000452783
  CDS Start-End: 80-2128
agagcgtcttctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctgggggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 178795 - DNA, 473 bp, Homo sapiens
  Payload ID: 15241
  Gene Symbol: SUN1
  Gene Name: Sad1 and UNC84 domain containing 1
  ENST ID: ENST00000419312
  CDS Start-End: 1-473
gtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctcca

SEQ ID NO: 178796 - DNA, 2725 bp, Homo sapiens
  Payload ID: 15242
  Gene Symbol: SUN2
  Gene Name: Sad1 and UNC84 domain containing 2
  Uniprot ID: Q9UH99
  ENST ID: ENST00000406622
  CDS Start-End: 214-2367
actcttgtttcgctccttgacaaccctggcgggggttcgctggctgcggccccggctccggcccccgcaggagcagctgcccctagggggagacagactcgcctgctgtgcctgggtcggaaggattcccgctgctcatcctcatcctggatacaggtggcaggcgccaagccaggattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccag

SEQ ID NO: 178797 - DNA, 4022 bp, Homo sapiens
  Payload ID: 15242
  Gene Symbol: SUN2
  Gene Name: Sad1 and UNC84 domain containing 2
  Uniprot ID: Q9UH99
  ENST ID: ENST00000405018
  CDS Start-End: 275-2491
cacacgcgcgccgcccggccccactcgcgcagcgcgggcctccgccggccgcattgtccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtggaagacagtgaaggaagaggctcgaaagtgacagagactgagccagtgtcctcgttccccgcaggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaa

SEQ ID NO: 178798 - DNA, 4055 bp, Homo sapiens
  Payload ID: 15242
  Gene Symbol: SUN2
  Gene Name: Sad1 and UNC84 domain containing 2
  Uniprot ID: Q9UH99
  ENST ID: ENST00000405510
  CDS Start-End: 360-2513
ggacttcccgggcagcctcccgggaggaggagggcaaaggccgactgccccaacccggccccgggcagcgcctacgggttttgtgccagacaggccgtttccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctgtggga

SEQ ID NO: 178799 - DNA, 872 bp, Homo sapiens
  Payload ID: 15242
  Gene Symbol: SUN2
  Gene Name: Sad1 and UNC84 domain containing 2
  ENST ID: ENST00000455125
  CDS Start-End: 1-597
gtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggtacgggatgctgctgtgctagcagaagtggcgcagactccccatccaggcagcaggtgctccctgggcacttaccctgccaggcatggggttcagagagggaagccctgctctcctttcccacagctcaagatgtgatatccaaatggggtgtaacacgcatcctgcagacgtcagcacaggggaaggcaccttccagaagggcagcatgagggaagcttcctggaaaaggacaccaggaggtgggctttacacaagaggggttgggtggccaggaaaggaaggccgggagaggcgttcgaggagccgccgccagcacatgccagggcgcgggcattctaccatggccagctggagcctcaggcagtgcatgcggcttaaacttcagtgggcatccgatctcctaagtcagt

SEQ ID NO: 178800 - DNA, 546 bp, Homo sapiens
  Payload ID: 15242
  Gene Symbol: SUN2
  Gene Name: Sad1 and UNC84 domain containing 2
  ENST ID: ENST00000439339
  CDS Start-End: 245-546
tccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggt

SEQ ID NO: 178801 - DNA, 454 bp, Homo sapiens
  Payload ID: 15242
  Gene Symbol: SUN2
  Gene Name: Sad1 and UNC84 domain containing 2
  ENST ID: ENST00000430185
  CDS Start-End: 1-431
cggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggcagggtttcaagagagaaccaaggcaaccagacctttgaggccttgatccagaaccagcacaccgtcact

SEQ ID NO: 178802 - DNA, 1012 bp, Homo sapiens
  Payload ID: 15242
  Gene Symbol: SUN2
  Gene Name: Sad1 and UNC84 domain containing 2
  ENST ID: ENST00000438058
  CDS Start-End: 341-1012
ccacacgcgcgccgcccggccccactcgcgcagcgcgggcctccgccggccgcattgtccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttc

SEQ ID NO: 178803 - DNA, 538 bp, Homo sapiens
  Payload ID: 15242
  Gene Symbol: SUN2
  Gene Name: Sad1 and UNC84 domain containing 2
  ENST ID: ENST00000420859
  CDS Start-End: 157-538
gttttggagaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccag

SEQ ID NO: 178804 - DNA, 444 bp, Homo sapiens
  Payload ID: 15242
  Gene Symbol: SUN2
  Gene Name: Sad1 and UNC84 domain containing 2
  ENST ID: ENST00000433561
  CDS Start-End: 115-444
ggatccagcctccacccgggtccgcggcccgcgccctgactcacctcctggcccccgccccgcctgccgcgccactgattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctca

SEQ ID NO: 178805 - DNA, 545 bp, Homo sapiens
  Payload ID: 15242
  Gene Symbol: SUN2
  Gene Name: Sad1 and UNC84 domain containing 2
  ENST ID: ENST00000417332
  CDS Start-End: 172-545
atttagttcttcccagcggcagcttgggtatggtataaacatgttgccttgtttctgccctgggcaaaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactgggaccccacttttcagaagctcttggaggcccagaagagcccctggttcttccctgcacaggtgaggacctgcgggtgcggaggaggaga

SEQ ID NO: 178806 - DNA, 621 bp, Homo sapiens
  Payload ID: 15242
  Gene Symbol: SUN2
  Gene Name: Sad1 and UNC84 domain containing 2
  ENST ID: ENST00000452294
  CDS Start-End: 188-621
gtagatttcagctcccagaggctcacttcttgttttggagaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggtaggcgatg

SEQ ID NO: 178807 - DNA, 1074 bp, Homo sapiens
  Payload ID: 15242
  Gene Symbol: SUN2
  Gene Name: Sad1 and UNC84 domain containing 2
  ENST ID: ENST00000456894
  CDS Start-End: 390-1074
gattcgcagtagtagatttcagctcccagaggctcacttcttgttttggagaatggggcctcgacctttttcatcttgtgaaacccagactcaatggtaaactgttttgtgatgccaggatgccgcaggaaagactgagaggcatctctgggagttctgggagggcggaggcgggtgctgacagttttcagcactccccgctcaacctccatcagaatatttagttcttcccagcggcagcttgggtatggtataaacatgttgccttgtttctgccctgggcaaaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatg

SEQ ID NO: 178808 - DNA, 1416 bp, Homo sapiens
  Payload ID: 15243
  Gene Symbol: SUN3
  Gene Name: Sad1 and UNC84 domain containing 3
  Uniprot ID: Q8TAQ9
  ENST ID: ENST00000297325
  CDS Start-End: 161-1234
tcaaaattccgtcttcaagaagaaacacccgtggaggaagaagacattatacaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaa

SEQ ID NO: 178809 - DNA, 1348 bp, Homo sapiens
  Payload ID: 15243
  Gene Symbol: SUN3
  Gene Name: Sad1 and UNC84 domain containing 3
  Uniprot ID: Q8TAQ9
  ENST ID: ENST00000395572
  CDS Start-End: 98-1171
aacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaa

SEQ ID NO: 178810 - DNA, 801 bp, Homo sapiens
  Payload ID: 15243
  Gene Symbol: SUN3
  Gene Name: Sad1 and UNC84 domain containing 3
  ENST ID: ENST00000453192
  CDS Start-End: 1-801
atgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgtaagaagctatatctgttgctttcttatagggcatcacaaaaaagaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 178811 - DNA, 1027 bp, Homo sapiens
  Payload ID: 15243
  Gene Symbol: SUN3
  Gene Name: Sad1 and UNC84 domain containing 3
  ENST ID: ENST00000453071
  CDS Start-End: 1-845
tatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggtcctggatgaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaa

SEQ ID NO: 178812 - DNA, 1456 bp, Homo sapiens
  Payload ID: 15243
  Gene Symbol: SUN3
  Gene Name: Sad1 and UNC84 domain containing 3
  ENST ID: ENST00000449896
  CDS Start-End: 111-380
acaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggctggagtgcagtggtgcgatcttggctcactgcaacctccacctcctgggttcaagcatttctcctgcctcagcctcccgagtagctgggaccacaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagt

SEQ ID NO: 178813 - DNA, 630 bp, Homo sapiens
  Payload ID: 15243
  Gene Symbol: SUN3
  Gene Name: Sad1 and UNC84 domain containing 3
  ENST ID: ENST00000412371
  CDS Start-End: 1-513
gaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaatt

SEQ ID NO: 178814 - DNA, 810 bp, Homo sapiens
  Payload ID: 15243
  Gene Symbol: SUN3
  Gene Name: Sad1 and UNC84 domain containing 3
  Uniprot ID: Q8TAQ9
  ENST ID: ENST00000438771
  CDS Start-End: 1-810
atgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgttcagaggtatatgtgcaggtttgttatacaggcgggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 178815 - DNA, 1448 bp, Homo sapiens
  Payload ID: 15243
  Gene Symbol: SUN3
  Gene Name: Sad1 and UNC84 domain containing 3
  Uniprot ID: Q8TAQ9
  ENST ID: ENST00000412142
  CDS Start-End: 232-1269
aacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggctggagtgcagtggtgcgatcttggctcactgcaacctccacctcctgggttcaagcatttctcctgcctcagcctcccgagtagctgggaccacaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaatt

SEQ ID NO: 178816 - DNA, 1254 bp, Homo sapiens
  Payload ID: 15244
  Gene Symbol: SUN5
  Gene Name: Sad1 and UNC84 domain containing 5
  Uniprot ID: Q8TC36
  ENST ID: ENST00000356173
  CDS Start-End: 94-1233
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctataggggccagcattgactttgagcacacgtcagtcacctataaccatgagaaggcccactcctactggaactggatccagctgtggaactacgcacagcccccagacgtgatccttgagcccaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaga

SEQ ID NO: 178817 - DNA, 513 bp, Homo sapiens
  Payload ID: 15244
  Gene Symbol: SUN5
  Gene Name: Sad1 and UNC84 domain containing 5
  ENST ID: ENST00000375519
  CDS Start-End: 20-388
atcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgtta

SEQ ID NO: 178818 - DNA, 1153 bp, Homo sapiens
  Payload ID: 15244
  Gene Symbol: SUN5
  Gene Name: Sad1 and UNC84 domain containing 5
  ENST ID: ENST00000375523
  CDS Start-End: 68-1132
cagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgacctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctataggggccagcattgactttgagcacacgtcagtcacctataaccatgagaaggcccactcctactggaactggatccagctgtggaactacgcacagcccccagacgtgatccttgagcccaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaga

SEQ ID NO: 178819 - DNA, 528 bp, Homo sapiens
  Payload ID: 15244
  Gene Symbol: SUN5
  Gene Name: Sad1 and UNC84 domain containing 5
  ENST ID: ENST00000420875
  CDS Start-End: 1-459
ggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgtta

SEQ ID NO: 178820 - DNA, 1373 bp, Homo sapiens
  Payload ID: 15245
  Gene Symbol: SLTM
  Gene Name: SAFB-like, transcription modulator
  ENST ID: ENST00000249736
  CDS Start-End: 15-1373
gctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaa

SEQ ID NO: 178821 - DNA, 4147 bp, Homo sapiens
  Payload ID: 15245
  Gene Symbol: SLTM
  Gene Name: SAFB-like, transcription modulator
  Uniprot ID: Q9NWH9
  ENST ID: ENST00000380516
  CDS Start-End: 89-3193
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgta

SEQ ID NO: 178822 - DNA, 2383 bp, Homo sapiens
  Payload ID: 15245
  Gene Symbol: SLTM
  Gene Name: SAFB-like, transcription modulator
  ENST ID: ENST00000432750
  CDS Start-End: 1-1803
ggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaa

SEQ ID NO: 178823 - DNA, 674 bp, Homo sapiens
  Payload ID: 15245
  Gene Symbol: SLTM
  Gene Name: SAFB-like, transcription modulator
  ENST ID: ENST00000560494
  CDS Start-End: 1-303
ggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagtt

SEQ ID NO: 178824 - DNA, 896 bp, Homo sapiens
  Payload ID: 15245
  Gene Symbol: SLTM
  Gene Name: SAFB-like, transcription modulator
  ENST ID: ENST00000558756
  CDS Start-End: 1-616
agacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaa

SEQ ID NO: 178825 - DNA, 717 bp, Homo sapiens
  Payload ID: 15245
  Gene Symbol: SLTM
  Gene Name: SAFB-like, transcription modulator
  ENST ID: ENST00000559880
  CDS Start-End: 30-717
ctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagattctgaagcaagtaagccaaaagatgggcaggacgccattgcacagagcccggagaaggaaagcaaggattatgagatgaatgcgaaccataaagatg

SEQ ID NO: 178826 - DNA, 585 bp, Homo sapiens
  Payload ID: 15245
  Gene Symbol: SLTM
  Gene Name: SAFB-like, transcription modulator
  ENST ID: ENST00000558486
  CDS Start-End: 10-585
tcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattct

SEQ ID NO: 178827 - DNA, 559 bp, Homo sapiens
  Payload ID: 15245
  Gene Symbol: SLTM
  Gene Name: SAFB-like, transcription modulator
  ENST ID: ENST00000559305
  CDS Start-End: 12-200
gctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggtaaaaaacatgaagcagatgagttgagtggagatgcttctgtggaagatgatgcttttatcaaggatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgc

SEQ ID NO: 178828 - DNA, 334 bp, Homo sapiens
  Payload ID: 15245
  Gene Symbol: SLTM
  Gene Name: SAFB-like, transcription modulator
  ENST ID: ENST00000557791
  CDS Start-End: 1-334
agcttcgttatgaacaagaaaaaaggaattccttgaaacgcccacgtgatgtagatcatagcaaatatttctcttcaaggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcc

SEQ ID NO: 178829 - DNA, 3022 bp, Homo sapiens
  Payload ID: 15245
  Gene Symbol: SLTM
  Gene Name: SAFB-like, transcription modulator
  ENST ID: ENST00000492526
  CDS Start-End: 15-548
gctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtat

SEQ ID NO: 178830 - DNA, 708 bp, Homo sapiens
  Payload ID: 15245
  Gene Symbol: SLTM
  Gene Name: SAFB-like, transcription modulator
  ENST ID: ENST00000559261
  CDS Start-End: 36-305
cactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaagattacaagctgaaacattaaatgtccagtgtgattgtattgtaacagctgttggaaacagtatgggacagcaaagttagaccatttttacataccccagtgctgcctcttgttgcctgtgcgtcatcgtcattgggcaacccattttccttctttcgcaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcag

SEQ ID NO: 178831 - DNA, 495 bp, Homo sapiens
  Payload ID: 15245
  Gene Symbol: SLTM
  Gene Name: SAFB-like, transcription modulator
  ENST ID: ENST00000560682
  CDS Start-End: 12-495
gctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagaagggagcctagctgaggctgatcacacagctcatgaagagatggaagctcatacgactgtgaaagaagctgaggatgacaacatctcggtca

SEQ ID NO: 178832 - DNA, 3021 bp, Homo sapiens
  Payload ID: 15245
  Gene Symbol: SLTM
  Gene Name: SAFB-like, transcription modulator
  ENST ID: ENST00000557924
  CDS Start-End: 35-223
actcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaat

SEQ ID NO: 178833 - DNA, 1040 bp, Homo sapiens
  Payload ID: 15245
  Gene Symbol: SLTM
  Gene Name: SAFB-like, transcription modulator
  ENST ID: ENST00000628684
  CDS Start-End: 34-222
ctcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatct

SEQ ID NO: 178834 - DNA, 1153 bp, Homo sapiens
  Payload ID: 15246
  Gene Symbol: SGF29
  Gene Name: SAGA complex associated factor 29
  Uniprot ID: Q96ES7
  ENST ID: ENST00000317058
  CDS Start-End: 188-1069
cgcgcgactacgctcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 178835 - DNA, 354 bp, Homo sapiens
  Payload ID: 15246
  Gene Symbol: SGF29
  Gene Name: SAGA complex associated factor 29
  ENST ID: ENST00000564023
  CDS Start-End: 1-272
atggggacgagcagtggatcctggccgaggtggtcagttacagccatgccaccaacaagtatgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctc

SEQ ID NO: 178836 - DNA, 788 bp, Homo sapiens
  Payload ID: 15246
  Gene Symbol: SGF29
  Gene Name: SAGA complex associated factor 29
  ENST ID: ENST00000567564
  CDS Start-End: 142-540
gacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaagttggagtgcaatgacgcgatctcggttcactgcaacctctgcctcccaggttcaagcgattctcttgcctcagcctcccaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaaca

SEQ ID NO: 178837 - DNA, 445 bp, Homo sapiens
  Payload ID: 15247
  Gene Symbol: STH
  Gene Name: saitohin
  Uniprot ID: Q8IWL8
  ENST ID: ENST00000537309
  CDS Start-End: 31-417
gcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagatgggagccccaggttat

SEQ ID NO: 178838 - DNA, 445 bp, Homo sapiens
  Payload ID: 15247
  Gene Symbol: STH
  Gene Name: saitohin
  ENST ID: ENST00000629377
  CDS Start-End: 31-417
gcatgtgtctgctgctccctagtctgggccatgagtgagggtggaggccgagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagacgggagccccaggttat

SEQ ID NO: 178839 - DNA, 4712 bp, Homo sapiens
  Payload ID: 15248
  Gene Symbol: SIK1
  Gene Name: salt-inducible kinase 1
  Uniprot ID: P57059
  ENST ID: ENST00000270162
  CDS Start-End: 134-2485
atgcggcgcggccccggaggcagcagcagcggcggcggcagccggagcagtaggcacccgagcagcgccagcggccgagcgggcggcttcctggcctgggcgctccggtggcggcggaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgcctcaggaaggtctttccaccgaccctttccgacctgccttgctgtgcccgcagccgcagaccttggtgcagtccgtcctccaggccgagatggactgtgagctccagagctcgctgcagtggcccttgttcttcccggtggatgccagctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagcttccaggagggacggcgggcgtcggacacctcactgactcaagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaa

SEQ ID NO: 178840 - DNA, 9678 bp, Homo sapiens
  Payload ID: 15249
  Gene Symbol: SIK2
  Gene Name: salt-inducible kinase 2
  Uniprot ID: Q9H0K1
  ENST ID: ENST00000304987
  CDS Start-End: 174-2954
gacgtcggcgcacgtcagcggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtgttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacaaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctcctaggaaagaaaaagtcagtggccctttcttcctcagatatcaagaactcccaagtgtttaaaccgtatgctggagtcagtggttgggacagacaggagcccaagactgaagccagcccttgcctcttgtgtcccttcccaactctggtgctggagtaatggggtgctctgcattttgatggggagcaaggggggaccccccctgtaggagtatcggcctctcccctgccccctaccctctctcgtggaccaaagtctccagcagaagagactcatcataagactgacgactcccccacctccacccacacaccgagtgtcatcagtcctaaaggcagggaaacgctcacagaattctgcccacgggttagatgtggggagaaggatattctcagctccagagtgattaggtgatcagccagaaactaaggcaaggtgacaagcagcagcctggagtcacagttggtcccaggcgtgtgggcactaagcagcctctggagacatgcgggcagttgaggatgcaaggacacagtgagtgagtggcgctcctttttggggtcctccagcctctagtcaagccccaggttcgtaaatatgtttgtattacattttaaaacctgtatcaacagtcacatttaagctccctattggtttaaagaaaattcatactccaggtaactttttcccattcgacctcctatagagacaatatgcagtgtgtcatttcacagtctcagtccctgtgaacagtggctgacaccggtgccagggctgacctgctacactcaaactcctaaactgggctgcctctaactgcctcctgggaagccacccgagccactcggtctctttgtgcctaaacatgaaaggtgaaaattggagaacagggaagctcgtaagttggagtcattgtacaggcagggatctttgatcattttgttgcttctggaatttatttaattttttttttttttgagacagagtctcgctctgtcacccaggctggaatgcagtggcgtgatttcagctcactgcaacctccacctcctgggttcaagccattctcctgcctcagcctcccaagtagctgggactacaggtgtgtgctaccgcatccagctagtttgtatatttttagtagagatggggtttcaccatgttgtccaggctgatcttgaactcctgacctcaggtgacccacccaccttggcctcccaaagtactgggattacaggtgtgagccaccacacccgacctggaatttttttatagaacttatcttcagagcaatgtatgaaagacaagagcagtatcagccgggcgcggtggctcacgcctgtaatcccaacactttgggaggccaaggcaggcggatcacgaggtcaggagattgagaccatcctaacacagtgaaacgccgtctctactaaaaatacaaaaaattagccgggcgtggtggtgggcgcctgtagttccagctactcgggaggctgaggcaggagaatggcgtgaacccgggaggtggagcttgcagtgagccaagatcgtgccactgcactccagcctgggcgacagagcaagactccacctcaaaaaaaaaaaaaaagacaagagcagtatcatctgcctctgtttctaaactggacaaagagattttcttaaagtttctatcatctcccttctgacaggttctacagtgtggtctgaagcacctgtaatgtcagagcccttgtctggcccttggtggcaggtgaacgaaagcagtggagcctctcaccttccagtagcctctcacattcttattttaccatttttgtcctaattaaggtagcctagctgattctagaagacagccatcctacgtgcacccccaccttgtgtccacatcttctccaggcaggtttcaacctatcagcagactcaggcacacactggggcacagatagagaaccaggcggcagcagtgctcgcagacccacccagggagagctgtgatgggttctgcccagatactctgctcgcccacccacaagggagcaatagcttatatttgtacattagttttaccaagcactttctcttctaaccctcacaacaattctatgaaattagctggggagatactgtccttatttttcacagctgaagaaaccaaagctttgggaagtttgtgacttctctgagatcacagctggtgatagaaggagctgggacacgcgcttgggttgactggcttctggttttggttctctggcttctagtgctggaagaagccctctctttcccttctctttcctcagtagcatctgactcttttcataagcaaacagctgtataaacaaagcccccattttggtcaagcacagggtgaatgtgatattgttcccacaaccttattctccactcaacagccgcctggctttggggaagaggccgccttcaggtgacagtgcagctgtccaggtggccgtgcactgaaccaggctgagggagacaaaaaccccgcagacccgcctgcctttcagcgtccagttaactgcagaagtttaggctcacctcaaagatgtctagtttttccaagttacaatacagcagtttcctacagaacacccccttcctcaattgccaaggggccgcatcgcacggcatcaggccaccactgcaggccagcagattccaccccaggaacggtcatgaactcagcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaactgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 178841 - DNA, 3063 bp, Homo sapiens
  Payload ID: 15250
  Gene Symbol: SAV1
  Gene Name: salvador family WW domain containing protein 1
  Uniprot ID: Q9H4B6
  ENST ID: ENST00000324679
  CDS Start-End: 365-1516
acgggatgtaggcggcggcggcggtagtggtagcggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaacta

SEQ ID NO: 178842 - DNA, 744 bp, Homo sapiens
  Payload ID: 15250
  Gene Symbol: SAV1
  Gene Name: salvador family WW domain containing protein 1
  ENST ID: ENST00000553731
  CDS Start-End: 1-204
gtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcagatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaa

SEQ ID NO: 178843 - DNA, 3034 bp, Homo sapiens
  Payload ID: 15250
  Gene Symbol: SAV1
  Gene Name: salvador family WW domain containing protein 1
  ENST ID: ENST00000555720
  CDS Start-End: 1-939
agaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtgccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaactaagcgcgtggtttttgagtccatgttttagacatagtgctgtatttcatttttctgttcaaaaggccatagacaaaggaatcaatataattgaaaggggtaatgaaaaggggtattgaaaaatgaaagtgtggctagtggaattttatcactgggaaaagataatttgctgaacttgtgatcagacttttctaagatgtcagtatatatatcttatgaactcccacactcctctatcttaattgttctttcctgtcacttcttactttatatcgctacttaattatggtgtagccatttctgtgacagtctttagaagtttctctgttttggacctcctagataagtattacttttttcattaacacactttccttcttcctctaagaagtctgttcagtgaaactccactagagattttagtcattaagaactagaagttacctaaaggaattagcatgttttgtaaaatagaaacttaagtttgtactgatgtcaacattaaataaaatgcatcttgagtctaaaaaaagagataaaccttcatcattctatatcagcacctctcattttcaaattcagtaagcatttgtttttaatcttaggaaccagagtaaactttaataatagttcacatattaaaagaataaacctatgaagaatacattctttgtgtaccaaatgaaaaaatatacaatgcagtgaaactcacatatacaaagtgattttttgtgcattttttatcaagaggtttatattctattaaaccatgtaaaagcaatatctggtttttgataaagcaactaaggaactctaaaatgtgcttaaaaataagattgtgatatatataagatgatacagattaaatccagcctgctgagttatgatgctgtgttttaacaaatggctaatgtgaaataatttaaaattttttctgtagaaattaaatgagcatatccaaacgtggaatatcacatgatttaattataacccagtagtagaatttagtaaattcaagcagaacacgtgtactgttatcataaatagacaaatactttataacagcatttttgaagaaaaatcaggaaattgtacatgttaacaaaatagtataaccatgcatacatacatctgcttattaaacactgaagtaaaagaactaatccagtttgcagtcttcagaggtgtttagtattttactccgttctgatggaagcactttgaatgtttgcatggagacataaaactgaatatttaattgacaattggtcatgcacctgtatttcttaaaatttgcattacatttttttcttttctgattgttcagtagattccgactttggtgtagggaaagcttgatgatacagatgtctgtgggttgctgctgcactgtaaagcttgtacaaagcctagaataaaagcatcaaaattataaaacattttattaaacacacagatgtaaaattttttcctttttagtttatcgtactgtataaaatttagcatgttgaatttgaaatcttttttaatcgatatataaattattatcttaaaattcaaaagtattttcaactcctcaa

SEQ ID NO: 178844 - DNA, 562 bp, Homo sapiens
  Payload ID: 15250
  Gene Symbol: SAV1
  Gene Name: salvador family WW domain containing protein 1
  ENST ID: ENST00000556735
  CDS Start-End: 331-562
ggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatgcgtcgagatgtgcgtcatgtttgcaaacattgcgggtgtctctcgactgtgctgcaagttgtgcgaactctggggcagaattccttagtcctgctgccggatgcagacttgagaagatcttatgccttcattcat

SEQ ID NO: 178845 - DNA, 338 bp, Homo sapiens
  Payload ID: 15250
  Gene Symbol: SAV1
  Gene Name: salvador family WW domain containing protein 1
  ENST ID: ENST00000557458
  CDS Start-End: 1-268
atttggaacctattatgtagatcacacaaataagaaggcccaatacaggcatccctgtgctcctagatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaa

SEQ ID NO: 178846 - DNA, 7711 bp, Homo sapiens
  Payload ID: 15251
  Gene Symbol: SASH1
  Gene Name: SAM and SH3 domain containing 1
  Uniprot ID: O94885
  ENST ID: ENST00000367467
  CDS Start-End: 476-4219
attttgaagagaggggtcccggggagctccctccaagatctagaggctccgcggccacccctgccgggtcctgccaagacttgctagaaggaacgagtcgcgtgccttagttagttggttcccgtcacaggaagaaacgcctttgcagtgggtttaattgcttctgggccgagcgaattccccgccgtacaactcagtggtgcggactttgcctcctgctaccctgttgctgcgccgagcggggtgggaaagtttctggagttgtcagtcgcgcagcccgtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgccgcggggactgggacgcacggcccgcgcgcgggacacggccatggaggacgcgggagcagctggcccggggccggagcctgagcccgagcccgagccggagcccgagcccgcgccggagccggaaccggagcccaagccgggtgctggcacatccgaggcgttctcccgactctggaccgacgtgatgggtatcctggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggaaaaggagactggaagaagaaaaataagtatttctggcagaacttccgaaagaaccagaaaggaataatgagacagacttcaaaaggagaagacgttggttatgttgccagtgaaataacgatgagcgatgaggagcggattcagctaatgatgatggtcaaagaaaagatgatcacaattgaggaagcacttgctaggctcaaggaatacgaggcccagcaccggcagtcggctgccctggaccctgctgactggccagatggttcttacccaacgtttgatggctcatcaaactgcaattcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcacttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatgcc

SEQ ID NO: 178847 - DNA, 591 bp, Homo sapiens
  Payload ID: 15251
  Gene Symbol: SASH1
  Gene Name: SAM and SH3 domain containing 1
  ENST ID: ENST00000367469
  CDS Start-End: 54-308
gagtcagagaggaagtcagagaccatttgaacgtatggccagcagctcacttcatggaggaacaagattgcagggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagtaagtctttctccctctgcccaggaccaccttccaagaaggtgtcttttaggtccatgctgacggaaatcaaacaggcgatcatgtgcgtatgtactatggagttatgcgatgtcattttccttaacatgttgcatgcatgtgtgtgtatctaggtggctaagagtgtgttttgtaatgcagttggtgatgtctgaggattttgtgaagagttactgattttacacttattgtgaataaaccctaaataaatctccggaaatagaaagggaaaggataggtgcatt

SEQ ID NO: 178848 - DNA, 5075 bp, Homo sapiens
  Payload ID: 15251
  Gene Symbol: SASH1
  Gene Name: SAM and SH3 domain containing 1
  ENST ID: ENST00000622663
  CDS Start-End: 1304-3277
agtggcttttactagaaaaacaacagtgaatttgaatcaagttctgcaaatacagaaatcactaagatataagcagttccgtgaagtttgcaaccacctaaaaggataataaagttttcattctttataacatcagcattgttcctactgaaattaaaaagtgtggtcaaacacagtcactgaatcaaccgttttctttctgggcaaatgtggcatcttcattcactgagagaaaagggtcaccatgaattaacttgggcagttcgatgggaaagttaccagcgtttttggctaggatggggaagcggtgagtgagtaattctcttggcctgattggacaactgtaaacataaccttctccccccctcttctcagcgatttaaagctaaacaaaatgaaagtctgtttgaaaagcttgctgttggtgtcagagccgtgggatttcaaacctgggttttcaggatgcctgagtacatggatcctctaacacatatcccttcattatctctactgaatgtagctgatgttaggggaagttctgtgctggagacagggaatctcacagcactggactcatggagggtttttcttttgttttttaggctttttaaaaaaaatggttggtttttgcatgttaaggggattctagacctctggggtaggcagagttccagtggcctgtgaaagggaaaaatgagtgaagtttccttacgacatgactcatgtgtttttttctcatcatttctcgttttctactttcatcctgtccacgtatttgtgattcagagatgtcctgcaaacggggactgctgggttggtgcactgccggctggcttaagcataactgaagtttttctgccctaccctcttttccacagagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatg

SEQ ID NO: 178849 - DNA, 2626 bp, Homo sapiens
  Payload ID: 15252
  Gene Symbol: SASH3
  Gene Name: SAM and SH3 domain containing 3
  Uniprot ID: O75995
  ENST ID: ENST00000356892
  CDS Start-End: 115-1257
gctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccacaccacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttacctgtggcctgggacaccagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaa

SEQ ID NO: 178850 - DNA, 4784 bp, Homo sapiens
  Payload ID: 15253
  Gene Symbol: SAMHD1
  Gene Name: SAM domain and HD domain 1
  Uniprot ID: Q9Y3Z3
  ENST ID: ENST00000262878
  CDS Start-End: 201-2081
attgcgcctgcgcagggagcccaaggcaagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggcctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcccagggcacacctcattcccagttctatagcaattcaccaagaacaaagtctgcagttagagccaaagctggtggtggccagagggtgctgaagatacaggccagtggggatgggagccatgagccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataagagaatagttaaaacacttctcctctcatgcctaccatggtgctgtatcaaggggatttgttcacatatgggctcagcaacgcacaagtgaggtcagccatggcactaggtcattcccattttagccaaggtgcctctataggggtcagacatcatgtgcccagacctaaggtcaggaatgtcatatttttctgttaaaatcattttatttctgtgtatcttacctttaaatcattgtggtttactctgagattctgtagtcctaatattgtatcattgtgctgtctgcaaaacaacttgaatctattttgtttgcatcttttgttacatgtaacgcagctgtactttatgttctttgcaactgtttccattatgagaacgctgtgctatttacaaggttacatttttcttggccaggcgaggtggtcatgcctgtaatcccagcactttgggaggccaaggtgggcggatcacttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaagaaagaaagaaagaaagaaagagaaagaaatatctttgctatttgtataaaaatggaaattttaacagcttagcctctagagagttactgaacgtggttaccttgggaatgtaaatagaactgcaaattaaaatgactggccacttcaactgggtaagggaaacagctgcaataaagcttcgtgaatata

SEQ ID NO: 178851 - DNA, 2185 bp, Homo sapiens
  Payload ID: 15254
  Gene Symbol: SAMSN1
  Gene Name: SAM domain, SH3 domain and nuclear localization signals 1
  Uniprot ID: Q9NSI8
  ENST ID: ENST00000285670
  CDS Start-End: 176-1501
ggaagctcagcagtgtccactgtcgccattccttggccatagaaaacaatgtatttgaattttgatgtaagcataacaaattgaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaataactgcaacttggaagataaattagcttggtatgaaggtgaagcttacatgtggcatcactggaagccttttcctgaaaaccctctctggacatgtcttgatttccaaatagcacaagttggaccctgggaccactgctcctcttgtattcgccacacacgtctcaagtcttcctgctcagatatggatctcctacattcatggcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 178852 - DNA, 1382 bp, Homo sapiens
  Payload ID: 15254
  Gene Symbol: SAMSN1
  Gene Name: SAM domain, SH3 domain and nuclear localization signals 1
  Uniprot ID: Q9NSI8
  ENST ID: ENST00000400564
  CDS Start-End: 81-698
tagacagcacactgctgactgttttcagttgtttctgtaacagcagaaagtgcactcactaggagtagtcagaattcaaaatgctcaagagaaagccatccaatgtttcagagaaggagaaacatcaaaaaccaaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 178853 - DNA, 1888 bp, Homo sapiens
  Payload ID: 15254
  Gene Symbol: SAMSN1
  Gene Name: SAM domain, SH3 domain and nuclear localization signals 1
  Uniprot ID: Q9NSI8
  ENST ID: ENST00000400566
  CDS Start-End: 83-1204
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 178854 - DNA, 2028 bp, Homo sapiens
  Payload ID: 15254
  Gene Symbol: SAMSN1
  Gene Name: SAM domain, SH3 domain and nuclear localization signals 1
  ENST ID: ENST00000619120
  CDS Start-End: 431-1345
cttatctgatgctgtgcattagacagcacactgctgactgttttcagttgtttctgtaacagcagaaagtgcactcactaggagtagtcagaattcaaaatgctcaagagaaagccatccaatgtttcagagaaggagaaacatcaaaaaccaaaggctgaagggctcgtccagccggggtggcaagtcagcaaaaggcgttaattgtgtctaacacagctatcatccttggggcaatattctgtatcacactgtctatcaagctaaccccttgccagagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgc

SEQ ID NO: 178855 - DNA, 1895 bp, Homo sapiens
  Payload ID: 15255
  Gene Symbol: SPDEF
  Gene Name: SAM pointed domain containing ETS transcription factor
  Uniprot ID: O95238
  ENST ID: ENST00000374037
  CDS Start-End: 416-1423
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 178856 - DNA, 1866 bp, Homo sapiens
  Payload ID: 15255
  Gene Symbol: SPDEF
  Gene Name: SAM pointed domain containing ETS transcription factor
  Uniprot ID: O95238
  ENST ID: ENST00000544425
  CDS Start-End: 435-1394
aactcttcatctcgcggctgtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 178857 - DNA, 1717 bp, Homo sapiens
  Payload ID: 15256
  Gene Symbol: SAMM50
  Gene Name: SAMM50 sorting and assembly machinery component
  Uniprot ID: Q9Y512
  ENST ID: ENST00000350028
  CDS Start-End: 158-1567
cggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttggaaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttaccttgggggacccacaagcatccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactccgag

SEQ ID NO: 178858 - DNA, 1591 bp, Homo sapiens
  Payload ID: 15257
  Gene Symbol: SAG
  Gene Name: S-antigen
  retina and pineal gland (arrestin)
  Uniprot ID: P10523
  ENST ID: ENST00000409110
  CDS Start-End: 231-1448
ctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccagctaaggaaagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgg

SEQ ID NO: 178859 - DNA, 556 bp, Homo sapiens
  Payload ID: 15257
  Gene Symbol: SAG
  Gene Name: S-antigen
  retina and pineal gland (arrestin)
  ENST ID: ENST00000453143
  CDS Start-End: 127-234
ctctccttgccacccggcccttcccacctggttggtgacaaatcacaaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcgatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccga

SEQ ID NO: 178860 - DNA, 791 bp, Homo sapiens
  Payload ID: 15257
  Gene Symbol: SAG
  Gene Name: S-antigen
  retina and pineal gland (arrestin)
  ENST ID: ENST00000447536
  CDS Start-End: 285-791
gagacctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatcccc

SEQ ID NO: 178861 - DNA, 556 bp, Homo sapiens
  Payload ID: 15257
  Gene Symbol: SAG
  Gene Name: S-antigen
  retina and pineal gland (arrestin)
  ENST ID: ENST00000415974
  CDS Start-End: 167-556
agcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaaggtgagatgaagccccttgtctcaggctggtttctgggcggagtggactgctctctgggcggctctgggaaggggcatttacatggaaggagagacaggaaggcagaggcagcgctcttgcacatggaaccagtgccaggcccactgacccacactcctgtacctaattcacgtgacataggtcctgttgacaccagagctcactcgctc

SEQ ID NO: 178862 - DNA, 556 bp, Homo sapiens; identical to SEQ ID NO: 178861
  Payload ID: 15257
  Gene Symbol: SAG
  Gene Name: S-antigen
  retina and pineal gland (arrestin)
  ENST ID: ENST00000625330
  CDS Start-End: 167-556

SEQ ID NO: 178863 - DNA, 556 bp, Homo sapiens; identical to SEQ ID NO: 178859
  Payload ID: 15257
  Gene Symbol: SAG
  Gene Name: S-antigen
  retina and pineal gland (arrestin)
  ENST ID: ENST00000630167
  CDS Start-End: 127-234

SEQ ID NO: 178864 - DNA, 1591 bp, Homo sapiens; identical to SEQ ID NO: 178858
  Payload ID: 15257
  Gene Symbol: SAG
  Gene Name: S-antigen
  retina and pineal gland (arrestin)
  Uniprot ID: P10523
  ENST ID: ENST00000631149
  CDS Start-End: 231-1448

SEQ ID NO: 178865 - DNA, 791 bp, Homo sapiens; identical to SEQ ID NO: 178860
  Payload ID: 15257
  Gene Symbol: SAG
  Gene Name: S-antigen
  retina and pineal gland (arrestin)
  ENST ID: ENST00000628376
  CDS Start-End: 285-791

SEQ ID NO: 178866 - DNA, 926 bp, Homo sapiens
  Payload ID: 15258
  Gene Symbol: SARNP
  Gene Name: SAP domain containing ribonucleoprotein
  Uniprot ID: P82979
  ENST ID: ENST00000336133
  CDS Start-End: 56-688
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaag

SEQ ID NO: 178867 - DNA, 726 bp, Homo sapiens
  Payload ID: 15258
  Gene Symbol: SARNP
  Gene Name: SAP domain containing ribonucleoprotein
  ENST ID: ENST00000552080
  CDS Start-End: 9-650
gtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggtaaaaatatacctggaacgcttcatagaccttgaagggaaattagagtgaataaactgaatggagaaatattgtttccccacctatttatttatttatttatttacttatttaagtcgagttgggg

SEQ ID NO: 178868 - DNA, 997 bp, Homo sapiens
  Payload ID: 15258
  Gene Symbol: SARNP
  Gene Name: SAP domain containing ribonucleoprotein
  ENST ID: ENST00000552884
  CDS Start-End: 22-180
agtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaa

SEQ ID NO: 178869 - DNA, 1163 bp, Homo sapiens
  Payload ID: 15258
  Gene Symbol: SARNP
  Gene Name: SAP domain containing ribonucleoprotein
  Uniprot ID: P82979
  ENST ID: ENST00000546604
  CDS Start-End: 24-656
ctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctc

SEQ ID NO: 178870 - DNA, 1272 bp, Homo sapiens
  Payload ID: 15259
  Gene Symbol: SAP30BP
  Gene Name: SAP30 binding protein
  ENST ID: ENST00000293208
  CDS Start-End: 8-715
gaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaagcttgttgcagggacgtgtctgcagcgcctggggaccggagctgtccttcccctgtgcgggcgggcaccgcctcctcctgggtattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcaca

SEQ ID NO: 178871 - DNA, 2439 bp, Homo sapiens
  Payload ID: 15259
  Gene Symbol: SAP30BP
  Gene Name: SAP30 binding protein
  Uniprot ID: Q9UHR5
  ENST ID: ENST00000355423
  CDS Start-End: 28-906
gagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcc

SEQ ID NO: 178872 - DNA, 1011 bp, Homo sapiens
  Payload ID: 15259
  Gene Symbol: SAP30BP
  Gene Name: SAP30 binding protein
  ENST ID: ENST00000542343
  CDS Start-End: 18-524
cgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggaca

SEQ ID NO: 178873 - DNA, 2722 bp, Homo sapiens
  Payload ID: 15259
  Gene Symbol: SAP30BP
  Gene Name: SAP30 binding protein
  Uniprot ID: Q9UHR5
  ENST ID: ENST00000584667
  CDS Start-End: 258-1184
cacaaccccaactcagagaagccaaagcgctgggaattcagctttaggcagaacccacgcaatcttatatccgtcgcgcagtgatgacgtagcgcgagcgctggcatgagggcggagccaggcgcaggaaactgccgttttgattggtttccagtgtggcgcgggggtctcctgggatccgaaagaacctgcctttccgcccggaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgcca

SEQ ID NO: 178874 - DNA, 538 bp, Homo sapiens
  Payload ID: 15259
  Gene Symbol: SAP30BP
  Gene Name: SAP30 binding protein
  ENST ID: ENST00000583063
  CDS Start-End: 212-538
acacttgagacaatggaggcaagggaagacttgtgacggagggcttggaccgtggctttctcagcattgattttggtttagatgaaacatttactacagaacagtgaaatccagaaaacgtctaagaagcctttgctctcaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaa

SEQ ID NO: 178875 - DNA, 2409 bp, Homo sapiens
  Payload ID: 15259
  Gene Symbol: SAP30BP
  Gene Name: SAP30 binding protein
  ENST ID: ENST00000582022
  CDS Start-End: 3-542
agatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgccagtg

SEQ ID NO: 178876 - DNA, 678 bp, Homo sapiens
  Payload ID: 15259
  Gene Symbol: SAP30BP
  Gene Name: SAP30 binding protein
  ENST ID: ENST00000578909
  CDS Start-End: 1-314
aggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagtaagcatgagactcggctactgaggtcggatagattagatagcctgggttacgtgtttggtttggtcttaatcttaagagaccatggcagggaaagggactgaggcttctataaaagaaactgacaggtgggaaggatcccacagtccactttacctcctgttagcctcatctcaggagttggctcctacacccaccgccatgtcccgtggtgctgctccagcagggcggccctgtcttgccttcagtgaagtcctaagcagagacagagaaaagaacgtaaccttttctgtgcagccctactgggccagtggtagcttctcagaaagagctttgctaagaaactgaggaaccctcagaatgtaaaataaattacagaaatgaaaaa

SEQ ID NO: 178877 - DNA, 553 bp, Homo sapiens
  Payload ID: 15259
  Gene Symbol: SAP30BP
  Gene Name: SAP30 binding protein
  ENST ID: ENST00000583170
  CDS Start-End: 123-233
cgttttgattggtttccagtgtggcgcgggggtctcctgggatccgaaagaacctgcctttccgcccggaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctggttgagaagcacaatgttagataatggaaacagattcctttgggagaataaagaacaagttacctaacaacatatcaggaccttagcttcctcatctggaaagtgaaggggattggattagaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggagaagctcggcacagtgacagaggcacccagggctcagcaagctc

SEQ ID NO: 178878 - DNA, 525 bp, Homo sapiens
  Payload ID: 15259
  Gene Symbol: SAP30BP
  Gene Name: SAP30 binding protein
  ENST ID: ENST00000583737
  CDS Start-End: 8-118
gaataagatggcggggaagaagaatgttctgtcgtctctcgcagtttacgcggaagattcagagcccgagtctgatggcgaggctggaatcgaggcggtgggcagcgcggctggttgagaagcacaatgttagataatggaaacagattcctttgggagaataaagaacaagttacctaacaacatatcaggaccttagcttcctcatctggaaagtgaaggggattggattagaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaag

SEQ ID NO: 178879 - DNA, 1558 bp, Homo sapiens
  Payload ID: 15259
  Gene Symbol: SAP30BP
  Gene Name: SAP30 binding protein
  ENST ID: ENST00000580322
  CDS Start-End: 1-746
tggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaagcttgttgcagggacgtgtctgcagcgcctggggaccggagctgtccttcccctgtgcgggcgggcaccgcctcctcctgggtgtgaggaggaggggcctggccaaacggttctgggcatgtgaggtggggcggtgggcggggggtgccgggcatgtgcagagacctggtgatgccgggagggatacagtactgtttggaaagttcttttaagagtgaaaagcccctttgggttcttcttagacatctcgccctaccccagatgggcagagcagagttcatttccaatgcctcttttgtgtagtgccaagctcctgtcccccaggagctgacggatggcaaaaagctgtggacacccagctttgcctggtcttattctcttccctctccctctccagattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattctt

SEQ ID NO: 178880 - DNA, 834 bp, Homo sapiens
  Payload ID: 15259
  Gene Symbol: SAP30BP
  Gene Name: SAP30 binding protein
  ENST ID: ENST00000584240
  CDS Start-End: 554-834
ctctttgcccacctgattggcagggggcagtggctcgaagagatgggttgctaagcagcctggcctggacgtggtgccctgccaggttgaatgaatagctgcagtgttctgaggaatggggaatttggcctgtcccagcatcaggagggactttctggaaagggggctaagactgagtctaggttcagtgtggggaactgggtggccttcctggcaccttccttttggagccgtggcgtggtgtgccatgtctgtgtaagtggagcctgcggagctctgcacctgtcctcgaaaaggtcttgttgcagggtcttcctgtctcatctcctccctcactcatcagcaggaaaagacatggcgtccagcaactttctgtgaactctgcctctgctgttttgatgatgagcacgtgtggcccttgagattgttgatctaactggctttgaggggctgggtgtcagcaacccagaaatgggggaaacaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaa

SEQ ID NO: 178881 - DNA, 1000 bp, Homo sapiens
  Payload ID: 15259
  Gene Symbol: SAP30BP
  Gene Name: SAP30 binding protein
  ENST ID: ENST00000583536
  CDS Start-End: 1-976
agagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggagaagctcggcacagtgacagaggcacccagggctcagcaagctcatggcccagcttgttggactcagagggcagaagaatcacattctaaacatgataaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttg

SEQ ID NO: 178882 - DNA, 561 bp, Homo sapiens
  Payload ID: 15259
  Gene Symbol: SAP30BP
  Gene Name: SAP30 binding protein
  ENST ID: ENST00000579877
  CDS Start-End: 12-125
gtgggaataagatggcggggaagaagaatgttctgtcgtctctcgcagtttacgcggaagattcagagcccgagtctgatggcgaggctggaatcgaggcggtgggcagcgcggctggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaa

SEQ ID NO: 178883 - DNA, 6226 bp, Homo sapiens
  Payload ID: 15260
  Gene Symbol: SAP30L
  Gene Name: SAP30-like
  Uniprot ID: Q9HAJ7
  ENST ID: ENST00000297109
  CDS Start-End: 649-1200
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatattttggtaatcaccttatccaccaggctgccacgtgtgagctgtagcttggaatagcagcaaggtgcaattggccatggaagtgcatgagcagacccacatctggacttgcatgctgcccgctggcgacatagatatcccgcccgctttgttgcaagctttgtcatttatcagcagatcagtttgacactggtccccctcactcaccctgtgccttgtacacagtaggcactcaatcagtaggtattggctaattgagctgtcactaatagtgccagccttgtaacatccgcttcacacctctcatgactgagacctctgccatttctgttgctcaccacttaactgctagaatgtggaggaaatcctgatgcaccaacaaggaagtttctgatcagataaggatttcaggacagttgcatgtgcaaaactattcgttgaggttccagaaacactgatatagagaccctcacagaagatacggtcccttatgcaccccactatgcttcactctttggggtgcagttagatattatgacttcagccaagcttcttggtaataaatgcattgacacactgacatatttagtaggttggggcaagtatttttagaagttttcatcctaagttcacaaccaccatgcaagctgccaggggccatgtgattcctgcccagaagttcagcttaggattgaaagtctggctggccttgactccctgggctctggtcatcagcaaatcatgagtttgggcaacaaaggtcaattccatctgatgctcatttttgtgaacaatttgcctccctcttagggagaaagattgctaaaataatttttgaaaattacctaatttttttgttgttcaaaacgttgaactcctcaatctaattatatcagagccaaagtatcctgtgaaaacaaagctttatatccaaaaatgtgcttttgcaaaattctttaatctgtgtaatggagggcagagggtatggggtaggagggtgggagaaagaaaagaaaagaatttggattctaatttatgaccatcttgacatatggtcaaaggtgtcattttcctactcagtttcaattctgagttaatttcttaagccttaaataataagaacaatggacagcctggcctggcagagagtttcacagatgacttaatctgagcaccatcacagagaagtcaggactaaaccccctactgagcagggcggcggagtgtccaaaggtctcagttctgtggagcagagtaccacgctttctgtggaatggggacagggtcaccacgctcactaaaatgcagtatgttccattgcagcaaagctttcgcctgtgttcaaaatgcatgtctagcagattgcagccttttaaattaaatatatataaatggttgtatatagaatatactctggactgtgagggcatcctattttggtatgcctcctggctgtggatggcatgtccagtgctctgtgagtgttttcagtcattcacattcactatgtgtttagagattctctccctgcttacagctgaaggatgttgatacaggcatcaagaaggctgaggggcagatggggcctgcaggttaaggcattgttaacttgctccatggaaatgtccatatcttaatgagtaaaaaagtgtatttttctgatacgtaaaccagaattgtgggcgtgtaggtcacatcactatttctttagcagcaaatctgttttcccagttgagagagacaatagcttctgcacaagaatatatgatggtaggatccatctgttcaattgtgtctgaaagaatctttattccaaagcgaaacctggggaaatgttttaccttcagccagatgctgtgtgtgtacttgggtcccttgtctttcctctaaggagaggtgcttgtggaaagtggaggttgtgggcatcttttcaaccttttcaatctgacctttcaacaggtcaggtgagagaaaagacaaagctatttgaacctatgtttttcttatgtccagaaatctgttctttcatcaaaccactaaaccactcgccttagcctcttctgcagtttctggtggctctatctgtgggcaagggactcctgcctgtgagaagtggccaggccctccagagcaacggggtctggcttcagggagcagtggggtgtggggaaagcaatgttcatcttggctgctccatttttataccatccatcaaggactcttgcgcttctctccacctgtgacgtagcagcattgccttctttcctcttggtgcttctgggcaaaactggaatttgaaatccagaactggcgttgtcttcttaaagagtatggttcctgcctcagttccagcctggtatggttctttgatatgccctgaaggttctcacatggaaacatcagtatcctgccattcatgttgttttaagatgttttaaaaaccaatggacaaacttcttgcttcaaggaacaaactcttaggttggcaacagcatataaaaaaaaagatcacagctgaatctcatgaaagattaaaaaccaaaggattcaagaccggtgttgtaaaatgaagaggaattttacttacatgttacagctgccaagtttttagatgttcctgtcatagctaaatagtcactgctagcctttcagagaacagatagtaacaattgtttgcagctgcagtgttgcatctaattttggtgtttaggctttttattttgtgggaagctttttgttaatatcctgcagggcaactgcctgttgggagggagaggatggaagaaggagcttactctgggggccttgcctattgagggaggctgttgcccagagcagttgcttcatggaagtcatccaaaggcgctctcagtcattacaatgacaggatctcaaagttgggaaagggctgttaagtcatccagtctagtctccacataggtgctgacattctgcctacaaccatcccaccaaggggttgagcagtctggacttaaacacctccgaggacagagaacccactacctcgtggagaagcctgttctttgtaaacctctggcttttctatgttctctgtaatttccatcttagtctctgccccatgggggccacatgggacaagttatttttggcaaagcacctaattgctggcactgtcccaaagcatagcgtttgccttttggaaagaaacaatgctaggacatggacactttggtacactgtccttacccctgagtattagtccactcagttccttgttggagaatgttgagaaaaccctactggctggcttgtttctgccaaagcttggggagaggagagggggatgagaagatgttagcagcctgctaaacctcagacagatgaggactcagttctgtgcttgccccacaaaaacggatgctcacatcatcaggaaattgttcagctggaggatttataacttcgttgctttgcatgaagtttaaagttttcatggttgcccagggcttgtaccttagattcctgtaaggactttgcactgtttttgctgagaaaacaacgcttcaggacttaaggtctaagcgtcagagaagtgccgtattttcaaggtggaaagtctgttaagcttgctgttgtccaatcatccgtttttagagatggggaaactaaaactcaaaaagatgtgcctgaggtcatatggcattatcagaaccaacctctggccctcttgacctgtctagcattctttctttctgacctataggatgactctaattcagtctaaatcggctgccctcagattcttgagaacttaaaattgagcagaaattcccaaggccaacctagctctcagggaccaacctgcagaactcaagattgagcgaaatgtttaggccagttgagttttgcaaaatgagtggtaagggaaaacagatctagcctgttatttaaaaccagggttcaaaagccctattgggagaggtagtattgtcctagcatttaaattctcatgaaatgtgcttggtctgtgatctcttggtcagatatctgccttccaggcgatcctttgaggttgtgtaattcagctggccctggctcctggtccctgttactgagctgggcagtcgaaccgaagggcagatgagctcaagatcatgccttgggaagcatggtgctctaggggtgcctttttattcctttcattgtattatagactgtttccaagtttatggttagaaatggtaaagtgggtctggtgttttgaggtagaacccagcctagggcaagatatgaactgttcttgaggtagaaatgtctacagtcagttgtttcatctagcttgcatcttaaaacacaaacccttcagttgctttcacttaatgcacacatttgccaatgacagagggttatacaggatccttcttttacatttctattgtctgctacgctcatcagagtatattttggggtacaaggttttgggggttttttttcccattttgtaactgccttattgaaaagtaagtgcccttccattccaggcctcctcatattgtacttgtttcctgccaaatctgggggatcatttgtattttaacttcgtaatctatggctctgtactgttgaaaggctctcaattctgtggggtctccttagtatgtatgtgacttttcatgttgcaatatcacacgatgggatggcccgacttttgctcttaataaataatctgaatgagtaagagac

SEQ ID NO: 178884 - DNA, 792 bp, Homo sapiens
  Payload ID: 15260
  Gene Symbol: SAP30L
  Gene Name: SAP30-like
  Uniprot ID: Q9HAJ7
  ENST ID: ENST00000440364
  CDS Start-End: 61-489
gcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatat

SEQ ID NO: 178885 - DNA, 777 bp, Homo sapiens
  Payload ID: 15260
  Gene Symbol: SAP30L
  Gene Name: SAP30-like
  Uniprot ID: Q9HAJ7
  ENST ID: ENST00000426761
  CDS Start-End: 61-474
gcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatat

SEQ ID NO: 178886 - DNA, 4214 bp, Homo sapiens
  Payload ID: 15261
  Gene Symbol: SRL
  Gene Name: sarcalumenin
  Uniprot ID: Q86TD4
  ENST ID: ENST00000399609
  CDS Start-End: 14-1435
cttggcagtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctctttaa

SEQ ID NO: 178887 - DNA, 1814 bp, Homo sapiens
  Payload ID: 15261
  Gene Symbol: SRL
  Gene Name: sarcalumenin
  ENST ID: ENST00000537996
  CDS Start-End: 176-1471
agacagcgcgtcagtgacaggcacacccgggccagggtcctctcctttcctcagcccgtctctctgtgacagaccctgcctgcactcccaagcccctctctccctgtacgaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctg

SEQ ID NO: 178888 - DNA, 5587 bp, Homo sapiens
  Payload ID: 15261
  Gene Symbol: SRL
  Gene Name: sarcalumenin
  ENST ID: ENST00000572111
  CDS Start-End: 9-1469
cagtcaccatgagggcgctggtcctgctcggctgcctcctggcctcgctcctgttctcaggacaagcagaactgcaagtctccgcgtcgggtggcacagaagatgttggcaatttgttggagaatcatttctctgctggagacgcaagtctagaggagaaagaaagggcgctttatgcagacacagcccctcaagacaagaaactgctccttcactacccagatggcagggaggccgagagccccaagaagacccccgcgtctgccgccagcgcgggccccgatcctgaagccagcctctccaatgcctcagccacagagtcacctccacctggggaaagggacgacagggacgctgcggggcctggggaggaaaagaatggcccaccagtggcaagcgccctccctccaggaggggccaaggggcctgtggaagaggagtggccggagcccagttctggagagggacaaggagaggaggagactgggtttgggctccccacggagggaactgccagtggagaggcaggaggacaggctgggggccatgaactccccgaggaagtccaggaggtccaaggggacagcctggtgcagggagcagtagcagggacagcagagccaaaggcagagggggcctctcctcactcagagggtgatggggtcggcccactgaacgcagaggccgagggcagccctgggcctggcgaggagcctgcagtgccagagggagcccctgacgtcgcggctgttgggggagagtcggagccagatattgacacacaagccagtgagggcaccgaggaccagggggagcccggcccagctgcagaggccagtgcagagcctgggggcgcccaaagcgttaaggcaggggacactgaggagaaccagtccccagagatgactgaggaggacgcagatgaagcctcctctgaagaggaaagtggtgatggaagtggaagcgaggaagaaggaggagttccctccgaagaggagtccgaagaggacagcggcgatggggctagctcagaagaagcagagggcgcctccgaggaggccacggagccccaggaggctggggagccccaggaagccagggagccccaggaaggcggggatctgcaggaagccgaggagtcccaggaaggcggggatccccaggaagccgaggagccccaggaaggtggagcgccacaggaaggcggggagccccaggaaggtggggatccccaggaagccagggagccccaggaagccagggaaccccaggaaggtgcagagcttccggaagccacaggaaccacaagtcacagggacagaggggcccagcctggcccggaggaattgaatacagagtccatgggcagtgagaccctggatatgaaggcagaggagcccgaggagggacatcagggggagggagagtcccatcattgttgcccaggaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctctttaa

SEQ ID NO: 178889 - DNA, 1432 bp, Homo sapiens
  Payload ID: 15262
  Gene Symbol: SGCA
  Gene Name: sarcoglycan, alpha (50kDa dystrophin-associated glycoprotein)
  Uniprot ID: Q16586
  ENST ID: ENST00000262018
  CDS Start-End: 37-1200
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctc

SEQ ID NO: 178890 - DNA, 1057 bp, Homo sapiens
  Payload ID: 15262
  Gene Symbol: SGCA
  Gene Name: sarcoglycan, alpha (50kDa dystrophin-associated glycoprotein)
  Uniprot ID: Q16586
  ENST ID: ENST00000344627
  CDS Start-End: 37-828
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 178891 - DNA, 696 bp, Homo sapiens
  Payload ID: 15262
  Gene Symbol: SGCA
  Gene Name: sarcoglycan, alpha (50kDa dystrophin-associated glycoprotein)
  ENST ID: ENST00000504073
  CDS Start-End: 1-481
cttggaccgtgggggccgtgtcccccttcccattgagggccgaaaagaaggggtatacattaaggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctgg

SEQ ID NO: 178892 - DNA, 1349 bp, Homo sapiens
  Payload ID: 15262
  Gene Symbol: SGCA
  Gene Name: sarcoglycan, alpha (50kDa dystrophin-associated glycoprotein)
  ENST ID: ENST00000502555
  CDS Start-End: 33-218
gtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacccctgaagttctacctttcccccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgaccaacagagcagggactcattcagggtccacagccagcgactggtaattgacaacattcttgagcacttgctatgtgcttggcactgtcccatcaacatattttatgctcaccaccactccaggagacaggtgctactattatccttctgacattacaggtgatgaaacagaggcacataatcatcctagctaagcacttgtctgagtctggattc

SEQ ID NO: 178893 - DNA, 542 bp, Homo sapiens
  Payload ID: 15262
  Gene Symbol: SGCA
  Gene Name: sarcoglycan, alpha (50kDa dystrophin-associated glycoprotein)
  ENST ID: ENST00000514934
  CDS Start-End: 57-254
ctctcctccctgccccctgtctctgtcactcaccgggcgggccaggccgggcagccatggctgagacactcttctggactcctctcctcgtgggcaagttggggccttgttcagcggggaggcccaggatgagggggcaggatttaggggtgttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaa

SEQ ID NO: 178894 - DNA, 668 bp, Homo sapiens
  Payload ID: 15262
  Gene Symbol: SGCA
  Gene Name: sarcoglycan, alpha (50kDa dystrophin-associated glycoprotein)
  ENST ID: ENST00000511303
  CDS Start-End: 1-591
ctgagacactcttctggactcctctcctcgtgggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 178895 - DNA, 1090 bp, Homo sapiens
  Payload ID: 15262
  Gene Symbol: SGCA
  Gene Name: sarcoglycan, alpha (50kDa dystrophin-associated glycoprotein)
  ENST ID: ENST00000513821
  CDS Start-End: 38-934
tctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctgg

SEQ ID NO: 178896 - DNA, 577 bp, Homo sapiens
  Payload ID: 15262
  Gene Symbol: SGCA
  Gene Name: sarcoglycan, alpha (50kDa dystrophin-associated glycoprotein)
  ENST ID: ENST00000512526
  CDS Start-End: 1-176
gctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgc

SEQ ID NO: 178897 - DNA, 4431 bp, Homo sapiens
  Payload ID: 15263
  Gene Symbol: SGCB
  Gene Name: sarcoglycan, beta (43kDa dystrophin-associated glycoprotein)
  Uniprot ID: Q16585
  ENST ID: ENST00000381431
  CDS Start-End: 224-1180
atacaacgcgccccaggccaaggtcctaggtgcaggggccgccgcagagcctgagcccgcagggctgggatgcgggtcgtcagggatgcgggctggggaggggagggtgtgagcagcgggtgcccccagtccccgccagggcgcaagcgcaggcgcgcagggtgcggtcgcggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagttcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattg

SEQ ID NO: 178898 - DNA, 663 bp, Homo sapiens
  Payload ID: 15263
  Gene Symbol: SGCB
  Gene Name: sarcoglycan, beta (43kDa dystrophin-associated glycoprotein)
  ENST ID: ENST00000506357
  CDS Start-End: 1-301
ggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatactccctggcagccaggcaagagacagaagagccttctctgggattcctgatgcatatagaaaaaagatctgaagatactgtcatttggcaagtcccgataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtg

SEQ ID NO: 178899 - DNA, 599 bp, Homo sapiens
  Payload ID: 15263
  Gene Symbol: SGCB
  Gene Name: sarcoglycan, beta (43kDa dystrophin-associated glycoprotein)
  ENST ID: ENST00000514133
  CDS Start-End: 1-282
caaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatactccctggcagccaggcaagagacagaagagccttctctgggattcctgatgcatatagaaaaaagatctgaagatactgtcatttggcaagtcccggtgaaaaagccatataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgagg

SEQ ID NO: 178900 - DNA, 1606 bp, Homo sapiens
  Payload ID: 15264
  Gene Symbol: SGCD
  Gene Name: sarcoglycan, delta (35kDa dystrophin-associated glycoprotein)
  Uniprot ID: Q92629
  ENST ID: ENST00000337851
  CDS Start-End: 520-1392
agagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaa

SEQ ID NO: 178901 - DNA, 9755 bp, Homo sapiens
  Payload ID: 15264
  Gene Symbol: SGCD
  Gene Name: sarcoglycan, delta (35kDa dystrophin-associated glycoprotein)
  Uniprot ID: Q92629
  ENST ID: ENST00000435422
  CDS Start-End: 488-1357
gagcagaagaaagagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagaccattcagaatcacacagcgtattaaacactgacagaatcttcatctagatattcgagtagcagcatatcttctcttttagtgtcattacgagggagtgatggcgggaatctcagtcgcactcaagctctgagacctttgtatcaaaaataggcatttgatttcctgttttagctttagtaaggctggctaacttccccctcttcaagctaggaactggcaatgctgtagaagtcagccgtaggaattcaaaatggctggcctaccttggctaccagacatattggggtttttgtagttgaatgaatgaggaggatgaatttcagcaaattttgaactgctcacccaacttctgctatcttgctccctccaaactcacagattctcctacagtcaaattaggagctgtaaatcagcacaaaataagataacagctgttcctcagtgagctggaagctacttaatggcctgatgggcaatgaacaaacgggtgatatgtctctgtttaagggaaaaatggcttaaaagctgttctgttctcacttctgactttaaccaaaagatttcaacccacaatgatcaggtcaatcaaaatccctaagagcagaactcctaccccaaaagaagcctggaagtctaattaagagtagcataaggaacctaattatgtttaccatgtttcttgggattggtgggaaatgtcaaaacatgccctttatttttaaaggcattcacaaactctctgactttgttcttcttatatattttttcagtgccgggatattcatattcctaaagccactattgtgttttctctaagaagcactacatgccaccagaattgtgcactgaaagataatacaaactgagtgtctttatgagaatcactgtgtcccctgaggcccagcagtacctgcttccctgtatgtggaagcagcacctcattcccgccatcagctacctctcatcaccccaccttcatcatcatgctccagggtcaccctggccagctcttgtgctgggacaggggattacaccatctctgttcaaagagggggaaatgtgcctatgccttaagtcaatgcactcagcaaggagaagcacatcttatttatcttgttacctatagtttactttgggtgattggaggggaatgacttagttatgactggacatcttaaaagctgatagacaagccaaatggctggcagatgatgtggatttcaaagagcccagaatgaactcatcactggcttagacagtcctggatgccatttggaaagtagtggccctgcaagcctaaatgaagtagtatttgtaggcctgggtggcatttggatttttcttttccctcaacaaggttttactttttcttactttacaagcaagggaagttttgtgataggagagaaataaaagatttgatattttttgagatgacactcaagcatcaggctgagatttgcacacatgggatgtaaaagcaagctgtgtgttgcttagtcacttacttagaagtagatggtgggggacagcggcgtgggtcctagcctggccagtgatgctgctggcgtccagaccccagactcactccaagcactcttgttcaatatctcatgcagaagagttgggctggtcactcttaggggtgagaccccgtgattggttggtttgtagcactaaggtctaaaaaggaaaaccataaaagacatcagattacgctggatcagtataattaatattccatagggccatgttgccagaatctgtatgtatcaatacagggtttttccaagccaggaaacgccctccttggctactaggagcacctatcccatatcattcagataaacaatgatagctacaaagtcatttgtggctagataggttaagacaggtgattttttaaagtagactgtctttgcattttgccatctgaagttcattaatctttagatgacaaaaaagcaaaaagttcccagaacgtttttgcttagattttgttctaatcaccacgtgaaggaatgagattagcaccacaagtttcatgccaataaaagagactggtgtgatcccacatgcaaaatttaatcctaagggtagtgagatcacaaacagaataaaaataagagcaatcaaccatataaatcaagtacctattgggaacagacataacattcaatttttcatttatgctaagtgaccacagtatacaaagtaataagcaggaaatttgatatgggttaaattatgcattttgttcagattttggaaattggtatgcattataagtttctcaatgtacatctttttatcccaacaccctcaaactagaatatttgtcagtggtcaagagaaaaaattttacctgaattcttgggggccggcggggagcttttacattaaaaatctactaacgcctactttttaaaaaatgagattctttctaatctttatatatgacattttctagacaatcgcacctttgggtatattaaacagctggtatcataacaaagaatccaaatgaaccttcaatatactagaagttctagtaggttaatattgttcagaagatttttacaaattaaaaactgatttccaaatatgttcaacatttacttctatttgatatctgctcaagaagtcatagaagtcttgggaaactattcgagtatcacagaggttttcaaaagcccttatggtgacatctacctaggtaaaagcctgacatgtggctttataattgttatgttacccaagggataaacttgaactggctttgaacatcctttaggtcattttctctttggataattttcatcgcatatccagcaactatagaccaaagtttgcttaaggtttgaccctagagcagaggtgggcaaactatgacctggaaaccaaatctgacttaccaccttttcctgtagttaaagttttattgtcacatagccacatacattcatttacatgttttctgattttacactacagcagcaggatggagtagttgtgtcagagactatgtatcccacaaagcatagattacttactatttagtcctttacaggcaaagtttcctcacccctgacctagaggtttttgtggtatgcattggatatagcaggaaagaaagcacatttccaaacagcagggagtaagcttacatttctgtgtaggtttgggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttagttcccatattcatctaattcatggggttctaacattttggggggccatagattcttttgacaatctgagccaatctatgaaacttctccccaaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagcttaaaaaaaaaaaaaaaagaccggaaaatacctgggttgttagcctcacatttaggaaaaaattgtaatactcagttatctgtgtgtgtggctaaacaagtcagcatttctgcacacatacatctctttcctttatacttcccttcaaaagacaaatatcttacttttgatctttgacactatttggtcagtattcttctttacctttacttgtggcaaaactcaaggaagcgatcaaatagagggaagctcatttctatcattgtctctgtttccctataagaaagaactaccagggactcactgactgcattaggcatacaatgtcagagctgagctgaccactctggtcctgtaatgtctttggcctcacaccttggcagccatcattaatgggccatacccttccccaggtgcagaattctcctccccagagcactcaggccgttactaccaatttatctgagttggaaataagactcatttgccagttcttatttttaaagtggcaccctttaactttgaacctgtgtattttacactggcatcctagattcagcaatgaggtttggtggtgtttcaactaggaagggagaaaatgagtgcatctgaagttccttacagcttggtttctttggaatgctttcatcttctaagcaaagggatcagggtttgatctgtaagagttaaaaagacaaagtcattttgaagaattaactcagccagggatcatgcaaaaagattagaaaccataatgcccttgttaaagccctgctgtcaacctgccttcacccagagcttagagggccacagcagcaaagaggttggggtccatccctctctgatgtgctttttccacaacacatatctggtcctctggcaggattgtggatagagctcctcaccatacccaaaagactcagccccagtgccagtgctttcctggttcaacaacccaccacaaaaccttagtaaaaggatgagccaaaaatgaaaaagactcgactctacagtaagtcagtcagggatttcctttttaatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaaggaggtcgtgttttagaaggaaaaggcagaggctatccatcattatgctggctagatgcgcttctgaagaagccggattctgatgttcttaaccaaaatggtgaggtcatggaagtcccatttgcttggagattttgaaaaaaaaaaaaaaaaaaaacccattcccataaagtaattgagttcagcctttggattatttttggtttggtttttctctggttttgggtgtgatgtaagaagagctttttagttttgttttgaataacatcaatccttgcacactctatgcaaaaattttgtaagcatttcaataatgctatgaattacaaggaactattttaactttattacactttctgtataaaaaatttgtatttaatattatttcgaccacagtcttgtaaaatatattaataaaaataatgattggtaagaaggaaa

SEQ ID NO: 178902 - DNA, 1412 bp, Homo sapiens
  Payload ID: 15264
  Gene Symbol: SGCD
  Gene Name: sarcoglycan, delta (35kDa dystrophin-associated glycoprotein)
  Uniprot ID: Q92629
  ENST ID: ENST00000517913
  CDS Start-End: 363-1133
gtgatatctattgaagctgggagggtcacagtatcagtgagtggtcccccaatttcttcttgagcatcgatgaattagcagtggtgtaatattgtggatctgacttcatgtgtcactaagaacaggagatccaagactgctcttctggggatgagacttggaagaaacctccatcctcagggatttgaagaaggttatactggaacctgtgtgaaggctgagacaaccgtcccttttgtggtggcctgaggggattttcttaatcccaatgttgccctgaaatttatgtccaggattcaaaaagtttaggactgctaagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaaga

SEQ ID NO: 178903 - DNA, 739 bp, Homo sapiens
  Payload ID: 15264
  Gene Symbol: SGCD
  Gene Name: sarcoglycan, delta (35kDa dystrophin-associated glycoprotein)
  ENST ID: ENST00000524347
  CDS Start-End: 329-577
agcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattagcatccatctgcttctgagatttaactggctattcagatgttgtggaatgagctgagaggagccagaaccaggagccaggtgactcagattccagtacccactttgctgctggatggaatgggaaacctgaggatcacagaaaaaggtctaaagctagaaggagactctgaattcttacaacctctctacgccaaagaaatccagtcccgaccaggta

SEQ ID NO: 178904 - DNA, 1694 bp, Homo sapiens
  Payload ID: 15265
  Gene Symbol: SGCE
  Gene Name: sarcoglycan, epsilon
  Uniprot ID: O43556
  ENST ID: ENST00000265735
  CDS Start-End: 112-1425
cgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaa

SEQ ID NO: 178905 - DNA, 1597 bp, Homo sapiens
  Payload ID: 15265
  Gene Symbol: SGCE
  Gene Name: sarcoglycan, epsilon
  ENST ID: ENST00000447873
  CDS Start-End: 69-1355
aagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttg

SEQ ID NO: 178906 - DNA, 597 bp, Homo sapiens
  Payload ID: 15265
  Gene Symbol: SGCE
  Gene Name: sarcoglycan, epsilon
  ENST ID: ENST00000425444
  CDS Start-End: 76-207
actggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtggaatatgaaagagacaaatgaagtagtggacagagaaagacttgacagtttgcttttaagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcag

SEQ ID NO: 178907 - DNA, 1508 bp, Homo sapiens
  Payload ID: 15265
  Gene Symbol: SGCE
  Gene Name: sarcoglycan, epsilon
  ENST ID: ENST00000437425
  CDS Start-End: 69-1259
aagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacaggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatcttta

SEQ ID NO: 178908 - DNA, 1409 bp, Homo sapiens
  Payload ID: 15265
  Gene Symbol: SGCE
  Gene Name: sarcoglycan, epsilon
  Uniprot ID: O43556
  ENST ID: ENST00000428696
  CDS Start-End: 1-1356
atgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggagattttcgtttgacaacttttcaaagatttgaggtaaatggtatccctgaagaaagaaaactgactgaagcaatgaatttataatcagacaatatagcagttacatcacatttcttttctcttccaataatgcatga

SEQ ID NO: 178909 - DNA, 815 bp, Homo sapiens
  Payload ID: 15265
  Gene Symbol: SGCE
  Gene Name: sarcoglycan, epsilon
  ENST ID: ENST00000450385
  CDS Start-End: 30-161
cgaggacggacggcctagccaggccaagaatgcaattgccccggtggtgggagctgggagacccctgtgcttggacgggacagggtcgggggacacgcaggatgagccccgcgaccactggcacattcttgctgacagtggaatatgaaagagacaaatgaagtagtggacagagaaagacttgacagtttgcttttaagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctag

SEQ ID NO: 178910 - DNA, 1666 bp, Homo sapiens
  Payload ID: 15265
  Gene Symbol: SGCE
  Gene Name: sarcoglycan, epsilon
  Uniprot ID: O43556
  ENST ID: ENST00000445866
  CDS Start-End: 27-1415
ggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaa

SEQ ID NO: 178911 - DNA, 1871 bp, Homo sapiens
  Payload ID: 15265
  Gene Symbol: SGCE
  Gene Name: sarcoglycan, epsilon
  ENST ID: ENST00000415788
  CDS Start-End: 89-1504
atgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaagaataataaattaatgtttatgaatgaatctaatagattaaaagataattatggcactatataatttatgaagctttatcttcaccaaataaggcaaaacacttgtgtcattccttaatcagacttaaaacctcagaataatagcttagattattacatagattggcatcagaatgataaacacagggtaaatgatcttagagcaaaagcatccatggaggtcctgtctaattaaggaagactgaatgaaacccctttccttcagtgaagttccctattcttccccttggtatgaaagattcttagcttggatgcatccaggatttgtctcagtaagtgagcagcttgaagtttcaagctctcttac

SEQ ID NO: 178912 - DNA, 408 bp, Homo sapiens
  Payload ID: 15265
  Gene Symbol: SGCE
  Gene Name: sarcoglycan, epsilon
  ENST ID: ENST00000522045
  CDS Start-End: 1-126
acggatttcctaattacactggctgtgccctcggcagtggcactggtcctttttctaatacttgcttatatcatgtgctgccgacgggaaggcgtggaaaagagaaacatgcaaacaccagagtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaa

SEQ ID NO: 178913 - DNA, 1624 bp, Homo sapiens
  Payload ID: 15266
  Gene Symbol: SGCG
  Gene Name: sarcoglycan, gamma (35kDa dystrophin-associated glycoprotein)
  Uniprot ID: Q13326
  ENST ID: ENST00000218867
  CDS Start-End: 125-1000
gttgctgaagcttcatcctttgctctcattctgtaagtcatagaaaagtttgaaacattctgtctgtggtagagctcgggccagctgtagttcattcgccagtgtgcttttcttaatatctaagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagcaggaatgggccacttgtgtgtaacaaaagatggactgcgcttggaaggggaatcagaatttttattcccattgtatgccaaagaaatacactccagagtggactcatctctgcttctacaatcaacccagaatgtgactgtaaatgcgcgcaactcagaaggggaggtcacaggcaggttaaaagtcggtcccaaaatggtagaagtccagaatcaacagtttcagatcaactccaacgacggcaagccactatttactgtagatgagaaggaagttgtggttggtacagataaacttcgagtaactgggcctgaaggggctctttttgaacattcagtggagacaccccttgtcagagccgacccgtttcaagaccttagattagaatcccccactcggagtctaagcatggatgccccaaggggtgtgcatattcaagctcacgctgggaaaattgaggcgctttctcaaatggatattctttttcatagtagtgatggaatgcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacaaccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatcttgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagtt

SEQ ID NO: 178914 - DNA, 2234 bp, Homo sapiens
  Payload ID: 15267
  Gene Symbol: SGCZ
  Gene Name: sarcoglycan, zeta
  Uniprot ID: Q96LD1
  ENST ID: ENST00000382080
  CDS Start-End: 717-1655
ctctctttctctccctctttttctctccgttggatccacctcctattccctcaactcttttagcataaccttcaaaggagaacgttcccttctgacttgattatcttcttttccccactgagaaaatacctctcagctacaagacattttttaagtctatgcaggacttcggggattctgttatcttgccggggaaactgatcattgctaatgcctgggactggagctaaattacctaccagagtaagcctgacggaggaagccttttatcatacactcttctcttcagtttgaacacatttgcttgaaatttgccgcatgatgctgaccagggaagcagctttttttctcgggatgcagcaattcgctgggttctaagcttattgcagaagaagaaataatcttaaatagagtggatttttttttccttttttcttttggcccctgtttcaatcgactcagctgtgttgcaccgcggtagagatcacctgtcactaaatctttgaggaagtaaaataaagtgaattatcattattatttatttattttccttatttttaacccggtggaggcggcgtgaccacggagaatgagactgagaggagctgccggggcttggaggaggataaagctgagtttaagctggaaactaaaagactagattgtttttgggtgccactcgcccggttcctctccacttcgtttagttgcgctccatggacagatcaacgaacctggacattgaggagctcaagatgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtggatggtatgggaaatctgagagtcaccaagaagggaatccgacttgaaggtatatctgagtttctacttccattgtatgtgaaagaaattcattctcgaaaggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcggtttcccttgtgatcagtccagagcttcttcgaatggtccacagagcaacttccagtgtgagcagggattcgccaccaccttctcttgtgatttactgtactgctcaacacagagggtgtgattgacacagcagtggaaaaagcgtcgtcagcaggaaaactggatcatgacttttgctcgaaagggagaataacataggtgcctttgctacgcgaagtgaagcacacagttttagatttttgcaggacctggatatgaactgcacatatatacattacataaatgaaattcccagtatccaatggcaagatgaaatggttaaccctgtaagaaaacttattctacattctgaaagcacaattttccattcatctttttggatgtaaacttttatccccgacttttaaaattttaaagcattatgtaatgcttgctttactaaaatttaaattcaatacatggtttttaacaaaacagaacaaaacaaaacaatacagaatctctccctga

SEQ ID NO: 178915 - DNA, 867 bp, Homo sapiens
  Payload ID: 15267
  Gene Symbol: SGCZ
  Gene Name: sarcoglycan, zeta
  ENST ID: ENST00000421524
  CDS Start-End: 1-798
atgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcgg

SEQ ID NO: 178916 - DNA, 1288 bp, Homo sapiens
  Payload ID: 15267
  Gene Symbol: SGCZ
  Gene Name: sarcoglycan, zeta
  ENST ID: ENST00000613692
  CDS Start-End: 165-710
tgtaggatggtatgggaaatctgagagtcaccaagaagggaatccgacttgaaggtatatctgagtttctacttccattgtatgtgaaagaaattcattctcgaaaggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcggtttcccttgtgatcagtccagagcttcttcgaatggtccacagagcaacttccagtgtgagcagggattcgccaccaccttctcttgtgatttactgtactgctcaacacagagggtgtgattgacacagcagtggaaaaagcgtcgtcagcaggaaaactggatcatgacttttgctcgaaagggagaataacataggtgcctttgctacgcgaagtgaagcacacagttttagatttttgcaggacctggatatgaactgcacatatatacattacataaatgaaattcccagtatccaatggcaagatgaaatggttaaccctgtaagaaaacttattctacattctgaaagcacaattttccattcatctttttggatgtaaacttttatccccgacttttaaaattttaaagcattatgtaatgcttgctttactaaaatttaaattcaatacatggtttttaacaaaacagaacaaaacaaaacaatacagaatctctccctg

SEQ ID NO: 178917 - DNA, 5433 bp, Homo sapiens
  Payload ID: 15268
  Gene Symbol: SLMAP
  Gene Name: sarcolemma associated protein
  Uniprot ID: Q14BN4
  ENST ID: ENST00000295951
  CDS Start-End: 1218-3653
ctggactacggcgcgggagagggggtaggagggcccttgaagggtgcgcgttcccgtggcggtgcaccgggtaggtttcagtcagagtcactatggcggccggcgctggcaaggtcggaaagtttcctgcctcgtcgggcgcagcttgagcttgccccatcggccgcgatcggtggaggctgcggcggatccagcccggggcctcaaggcctctccccaacctccgggccagtctccctcccccaccttctcgtccgccgggagctgcggctgccgtccctgagatgcgaccctcgcgggggcgaccctgaggggaggcggcccatgtgctgagcggcggcccagaagcctaggcgtccggggaccaacttcctgccgcctgggaactcgagcctcccggtgtcgcgcctcgctcggtccgcaccggcctgcggagccgggtccccgccctggtcgcggggacgctcgccaggtgcccaggagtcccgacttggccactgcccgcgccccgccggcctccacgcctcgcgcggagaacctcagccaccgccgtctcggatcgtgccaggccggggaccgcgtcccccttcccggggcggcctccgctcagcaggggcgatgcagactgtcccgccggccgtctagagcccctccgtctccgtcacctctcgccccttcactccgggcgaggactggcggtggctgcccagaggtgcccagccacaccttccttcggcccaaaaggactttcctggccgcgccgaaccgacccttcattcatgctgcagtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 178918 - DNA, 4420 bp, Homo sapiens
  Payload ID: 15268
  Gene Symbol: SLMAP
  Gene Name: sarcolemma associated protein
  Uniprot ID: Q14BN4
  ENST ID: ENST00000295952
  CDS Start-End: 206-2641
tttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccct

SEQ ID NO: 178919 - DNA, 6749 bp, Homo sapiens
  Payload ID: 15268
  Gene Symbol: SLMAP
  Gene Name: sarcolemma associated protein
  Uniprot ID: Q14BN4
  ENST ID: ENST00000383718
  CDS Start-End: 99-1619
tttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggggatacaagttgatgacttcttacctaaaataaatgggagcacagaaaaagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaaggtactttaacatgtttttatgacatcgtaaaccagggtatcaaatcaccctttgccataaaatctgttctagatattatgtgaagttttaatttttagttaagagattaagataggttctgtaaagtagcagggactaaaaatttaaagttttggtgtttatacccaatatttcaaactattgttgaataatttggatcagtcaagattacgagggacaaagtgttaagtggtagaatatgaaatgcagctgtgttttttgtttacccttgtgtctctaataggaatttattagcgcttttaacataattagaataaggtgaaaatcttaactttcttgaaagactcaccggtttactctgttatcatatggtagcagttgtaaatttccttattttctggtcttcttcatcttctaataaatatccccaggttcttatgacactcttctagaaattttgggctaagaaactttaggtggatggccaggcatggtggctcacgcctgtaatctcagcactttgggaggctgaggcaggtggatcatctgaggtcaggagtttgagaccagcctgaccaacatggagaaaccctgtctctactaaaagtacaagattagccgggtgtggtggcgcgtgcctgtaatctcagctactcgggaggctgaggcaggagaattgcttgaatgcaggaggcagaggttgtggtaagaggtcatgccattgcactccagcctgggcaataagagcaaaactccatctcaaaaaaaaaaatgaaaaaaagaaagaaattttagatgttgataagataagtaatgcatgtaattaactctttgtctcacctctaaacaggaagtacatttcttgatatttacttgtttagaatgaagtgggtagaaaataaatcagcatttataaaaatgtttttaaaataaagttccttggggatagtttactggaaaattgtcaacattcagtctcttttatgttgccttattgtacacaagaaaaattgacatatgttgtaagttcagcccagtgggtttattaaaaatgttggtagtggtgtactaacaccagacagctctctgggatcagagtgacagtagcagcctgtggaaatttctctttgtggaagtgccgatttttctggctggactaatagggaatctccttgtccagaccccgagctttgggattatataaggaaggagcactcttactgatttgtactcttcttaggtgatctttggtgttgataagacatgctttttttctaatgtcataataataaatataagttaatgttggtatgatccagaactctcatctcagaaatgcaataccattattgtgtaaaatgtagttactgatactgaaagaatgtcagaccctatgggcctttatgggaacgtggagaaaaaagaagggaggtaaatgagtaatgaacacacccatacaaaagtagccctctttatggtcttttgcactacagaactctcttttttctttttctttttttctttttgtaggtacatagtaggtgtatatatttatagggtacatgagctgttttggtacaggcattcagtgttacagaaatcttttcaatagccaacttaagattgagtatagtgtttatgattgtgttaattgtattcaactattattagtgcttttgtgatttttgtcagtctgttttagatttgatttttatcccattgcctaccacaatgcaggtattcagtaaaactcagatatttgatgaattaattgataatggacttcttacattaaaattataaagacacaagagcattaggaaagtaacactagccacaaagctaagagccaaagaactctgggttcagtcataggtttgccatttatttgtaatatgtccttggcaaattgcttaactgctctgtgattcagggttttttcatgtattagactggcgaaaaccaactttataggtttattgtgaagattgaatgaaagggtgtgcatggaccacttaccatggtgttgggaacataaaatgttaaccaccataatgaagacactgatcatgatgatgatggtgattgataaaagcaggcctatctgttgaaggactctgagtaactccatattaattgaataagattgtggagttttaaaattatttcctatagtatttaggaacaaggatttgtttgtaatggattttttctaattagtaatgcatttatttgtttgttacttgccagataatcaggaaaaaatatttttaatccatgagtagcaccaaacagtatctataaaagtactcacaatatagcctgggaagtcagactcaaggaacagggaatgaaaggggaaagatgtaggaaaagattggaaaatacaagatgcatgtggagctggcggcctgtgtgcagatgctattagtaattgcttcaggtgccattgatgaagatgggtcagagtttccctaaccttgctttacgttaaggtgaaagaacttctaaaacttttctttacatttctgtatgattgccaacttttttgttaatgaagtagtatctttataaatacctgctgaaagattttgtggcttgattttatttttatgaatttttttacttattttgttttgttttgtttttagagacaggggtcttgctaagttggtcaggttggtcttgaacttctgagctcaagcgttcctctcacctcagcctcccacctcagcttcccaagtagctgggactacaggcatgcaccaccctacccgacttgtttactctttcactttgtttctctttctctctctgtctctctctctttttgcagcttgattttaagaacagactgtcaagtcagtcagtgattggatgtaaagaaaaatcatctaggtagaaggaggcatattttagaagagtctccaagagataattatcatagccctttatggtcattattatttttcttttgtaaagtttctcttgtaagagttttacaaattcttaaaagtgatgtattactggtactttttagaaacatttatgttatgcttgattatgtgtggttatggtttgtatctgtataattaggttcaatagactgacataattttctcttaaaagtataaattactagacaacagtgttgacctttacagctatataaggcagctacatataagtagcctctttattttcctcattcaaactttgtgcctgacttcccgaaccattattttcaagttttttttccccttttttaaaaaatagccaatctttttctttagatttattgtgtacgacttgtcacatttgtcagctaggacaaggaaaataataataaacattcattatgagataaaatgatgatagcagtagtaccttttccctgatatagtaatcatttctatctatttagttacttttaaatgagaaataagttgatcaaaccatgttttctgtatgcttgaaaccatctcccataaaacgttttttaaaattggaattcacttcaaatcatgtctgttgcaaatttgctctgtttggggaaccttgccagggactgcagtggttttaaagtctaataagactgtcgggccggacgtagtggctcatgcctgtattcccaacactatgggaggctgaggcggcctgatcacttgagcccaggagtttgagaccagcctgggcaacatggcaaaaccccatctctacaaaaattagccaggcatggtggtgcatgcctatagtctcagccactcagaaggctaaggtgggaggatcacttgagcccagacggcagaggttgcagtcagcccagatcgtgccactacactctagcctcggtgacagagcaagactctgtctcaaaaacaaaagcaaaaatctatcctctggatttaaggaatttcaaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggtttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgtggaagattctacaggacatacaacccagtttctttagcaattaaattagaaggggaaaaaaaggaaaggggatgggggaaatcctataaattaaaagagatttaagagttatgtcggccaggcgtggtggctcacacctgtaatcctagcattttgggaggccaaagtgggcagatcacttgaggtcaggagttcgaacctagcttggccatcatggtgaaaccctgtctctactaaaaatacaaaaaattagctgggcttggtggtgcacacctgtaatcccagctacttgggaggctgaggcaggaaaatcgcttgaacccgggaggcagaggttgcagtgaaccaagatcatgccaccacactccagcctgggtgacacagcgagactccatctcaaaaagaaaaaaagagagagagatgtcaactaaatataatgtatgaaccttgtatgaatcttcattcaaacaattcaactgtaaaataaatttggaacaatggaaaattttaa

SEQ ID NO: 178920 - DNA, 1570 bp, Homo sapiens
  Payload ID: 15268
  Gene Symbol: SLMAP
  Gene Name: sarcolemma associated protein
  ENST ID: ENST00000416658
  CDS Start-End: 1-1300
acaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaag

SEQ ID NO: 178921 - DNA, 2274 bp, Homo sapiens
  Payload ID: 15268
  Gene Symbol: SLMAP
  Gene Name: sarcolemma associated protein
  ENST ID: ENST00000438794
  CDS Start-End: 1-949
agggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagaggtaaagcgaaaagacattatgagcccaattatggttggacttaaagccaaaagcaaatcggatatccatgctagttagaaataaagggaagcagaagtcacattacctgtcacaaaattgatacttggaacatctctgcttggtgatttctagctgcatatcatggtccatatgtagagaattcttcagtagggttggtctcaaaaatataatatacaaaactacattttaatttttctctaccagttacttatatgagaaatcctttgtaccaggtctcttgatctattgtttaactttcaaagagagtatcgtatgtaacttagcatacttttggaaagcaaactgaggccatactctaatgctgtctgaacccctcaggtaaatatggcctgaaaagttacttaaaattcacctcatagccaggcagccagccaaacacatgttctgtggccttttactttcttcctcccacccccttttcaccttattcataaatgtgcatgctcacttttcatgtcattctgcttaaaaccttgagttgagtggctttttaaaaatttgtgttgaagtcataacagttgattttggaacagaaaccctacccagtttcttcctgagcaagagaggtgcatttcacttcccaaagccttgaagttgacagcagggcagtaagagctgtcttcagtcctgctggcctcataccactccctgcattgactcctggccagctcggggaatggagaagcctgatacaacttgatctacagattagggaccaccccagttgtagactttcttaaaaggattctttatgaattagaaggaagttgaagacaactctttgtctttaataatgaactttcccaaagttgtttctagaagatctgcttaatcaatgcagtttttctttgcacttttctttccttgtagtgtcctgaatttggcaatgattgttcttctgtcttcatgtttgttcctaatgaaaaaatactgtaacattttttattttcttgcggacatactgattttgtgatgtgttcgtttttaccttactaaagatatgtgttttagaagaaatctcattttatttggttggaacacaaattttgtgccaaagtaaatatcttagtatttaatactgtaagcactttgtgtccttccagtccatatgccataattctttcaaactctgggaagaatgctgtggttggaagattattctgttgtatgttactatgaacgcattagtcattttgttgcattacttgtttgcctgtttttggtcactgagtaatcggtgcaagatgctttaactgtttccacaaatggcagtggcatgttgtcacagcatctaaattgttgatagtcttggattgcattaaatgcagcacatttaaaaa

SEQ ID NO: 178922 - DNA, 4132 bp, Homo sapiens
  Payload ID: 15268
  Gene Symbol: SLMAP
  Gene Name: sarcolemma associated protein
  Uniprot ID: Q14BN4
  ENST ID: ENST00000428312
  CDS Start-End: 95-2581
ggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactcca

SEQ ID NO: 178923 - DNA, 3066 bp, Homo sapiens
  Payload ID: 15268
  Gene Symbol: SLMAP
  Gene Name: sarcolemma associated protein
  ENST ID: ENST00000417128
  CDS Start-End: 1-1229
agaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacac

SEQ ID NO: 178924 - DNA, 4027 bp, Homo sapiens
  Payload ID: 15268
  Gene Symbol: SLMAP
  Gene Name: sarcolemma associated protein
  Uniprot ID: Q14BN4
  ENST ID: ENST00000449503
  CDS Start-End: 95-2467
ggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaat

SEQ ID NO: 178925 - DNA, 565 bp, Homo sapiens
  Payload ID: 15268
  Gene Symbol: SLMAP
  Gene Name: sarcolemma associated protein
  ENST ID: ENST00000461354
  CDS Start-End: 261-565
agcattccattttggacaagggtggtgaagaagtaagagattcagtgacctgacctattttaaaagtactttgcgtacctgtagattttgagcattcatagcctgaagcagttttattgatataagatatttaactgtaataagattttacttttatttttttcttggtagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacag

SEQ ID NO: 178926 - DNA, 1305 bp, Homo sapiens
  Payload ID: 15268
  Gene Symbol: SLMAP
  Gene Name: sarcolemma associated protein
  ENST ID: ENST00000494088
  CDS Start-End: 152-1108
ataatttaatatgagctacgtgtaataaccagcattccattttggacaagggtggtgaagaaaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctctta

SEQ ID NO: 178927 - DNA, 1383 bp, Homo sapiens
  Payload ID: 15268
  Gene Symbol: SLMAP
  Gene Name: sarcolemma associated protein
  ENST ID: ENST00000495364
  CDS Start-End: 223-1311
gtttccagttggcaagtggacagccttgaacaaaagccccagccctcagcaaagcagacatgatccacattataatttaatatgagctacgtgtaataaccagcattccattttggacaagggtggtgaagaaaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacaga

SEQ ID NO: 178928 - DNA, 511 bp, Homo sapiens
  Payload ID: 15268
  Gene Symbol: SLMAP
  Gene Name: sarcolemma associated protein
  ENST ID: ENST00000465203
  CDS Start-End: 1-511
gaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagggatacaagttgatgacttcttacctaaaataaatgggagcacagaaaaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacag

SEQ ID NO: 178929 - DNA, 587 bp, Homo sapiens
  Payload ID: 15268
  Gene Symbol: SLMAP
  Gene Name: sarcolemma associated protein
  ENST ID: ENST00000466255
  CDS Start-End: 260-587
gcattccattttggacaagggtggtgaagaagtaagagattcagtgacctgacctattttaaaagtactttgcgtacctgtagattttgagcattcatagcctgaagcagttttattgatataagatatttaactgtaataagattttacttttatttttttcttggtagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttg

SEQ ID NO: 178930 - DNA, 855 bp, Homo sapiens
  Payload ID: 15268
  Gene Symbol: SLMAP
  Gene Name: sarcolemma associated protein
  ENST ID: ENST00000460223
  CDS Start-End: 1-197
aagaacttgagaatcaagtgggatccttgaaagaacagcatcttcgggattcagctgatttaaaaactcttctcagtaaggcagaaaaccaagcaaaggatgtgcagaaagagccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttt

SEQ ID NO: 178931 - DNA, 722 bp, Homo sapiens
  Payload ID: 15269
  Gene Symbol: SLN
  Gene Name: sarcolipin
  Uniprot ID: O00631
  ENST ID: ENST00000305991
  CDS Start-End: 175-270
agtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttc

SEQ ID NO: 178932 - DNA, 436 bp, Homo sapiens
  Payload ID: 15269
  Gene Symbol: SLN
  Gene Name: sarcolipin
  Uniprot ID: O00631
  ENST ID: ENST00000525934
  CDS Start-End: 118-213
ctgtctgctgctgaggcctgcagagattaatataaacggcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtaga

SEQ ID NO: 178933 - DNA, 906 bp, Homo sapiens
  Payload ID: 15269
  Gene Symbol: SLN
  Gene Name: sarcolipin
  Uniprot ID: O00631
  ENST ID: ENST00000531293
  CDS Start-End: 354-449
attttcttgctcttgagctctggcacttctctgctgctgtctgctgctgaggcctgcagagattaatataaacggcagcctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaa

SEQ ID NO: 178934 - DNA, 2952 bp, Homo sapiens
  Payload ID: 15270
  Gene Symbol: SAGE1
  Gene Name: sarcoma antigen 1
  Uniprot ID: Q9NXZ1
  ENST ID: ENST00000324447
  CDS Start-End: 75-2789
ctgcacagcaacataagcagaggaatgcagaaccttctcacccagcgggatgaaatcgcctggactatctgcagatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccatcacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgc

SEQ ID NO: 178935 - DNA, 2879 bp, Homo sapiens
  Payload ID: 15270
  Gene Symbol: SAGE1
  Gene Name: sarcoma antigen 1
  Uniprot ID: Q9NXZ1
  ENST ID: ENST00000370709
  CDS Start-End: 1-2715
atgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccatcacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgca

SEQ ID NO: 178936 - DNA, 1824 bp, Homo sapiens
  Payload ID: 15270
  Gene Symbol: SAGE1
  Gene Name: sarcoma antigen 1
  ENST ID: ENST00000537770
  CDS Start-End: 75-1661
ctgcacagcaacataagcagaggaatgcagaaccttctcacccagcgggatgaaatcgcctggactatctgcagatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgc

SEQ ID NO: 178937 - DNA, 1484 bp, Homo sapiens
  Payload ID: 15271
  Gene Symbol: SARDH
  Gene Name: sarcosine dehydrogenase
  ENST ID: ENST00000298628
  CDS Start-End: 294-1484
agttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttag

SEQ ID NO: 178938 - DNA, 1326 bp, Homo sapiens
  Payload ID: 15271
  Gene Symbol: SARDH
  Gene Name: sarcosine dehydrogenase
  ENST ID: ENST00000371867
  CDS Start-End: 138-989
ggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggcagtcaaatacagacccagggcagctggagggctttgcctcaaaacatccacagagaaggtctgcgcagtgtggagtgatgacctcagaagggcatgagagcacacaagtcctacgtccttcagcaaatgacactgccctcccaaccagctgctgcagcggcatttcccctggcctgggctgtttcccgggcagcttctggggttagggcagccctgcagccctgttctatgtgtatatgcatttagtccacacatggaacgactgagtggctactttgggctaaaaactgctttaatttctggagaaagagggaaactaagataaaagtccctgactctgggtgcctatattttggtggagagacatacaataaacaaacaaatggctgggcacggtggctcacacctgtaatcccagcactttgggaggctga

SEQ ID NO: 178939 - DNA, 2266 bp, Homo sapiens
  Payload ID: 15271
  Gene Symbol: SARDH
  Gene Name: sarcosine dehydrogenase
  ENST ID: ENST00000371868
  CDS Start-End: 835-1941
gtgccgtgtcggcagttaggagggcaggtggcggggtggggggttgtctgcaggagcagcggccagggaggggcatggggctgtggggctgtggggtgtctgatgggggcagatcccagggaggccaaggcagtggcagaaaagctggactctggagcccacgcacctgcctggcttcgtgccactgccaggtccaggacttgtctgtgcccttgggcgagatataacttctctgcgcctcactttcctcatctgtagaaaggggcacacctggtaggagtgtaagacgcttcccgcaggggctggcccagagcaggagctgggcctgggattgccgtggctccagggagcagccctggctgaggtcctgggtaaccacctctccctgtcgttccccaccttgggtgcatccagctcctcctccagcctcctgggccctggctgggctctcagacccaccaggcaaccctgcggcctcctttgtgcctctgttttgcctggacctcatgggggccccctgcccgcgtccacaacacacgggcactcagtgcagggctctccgagggcagggccaggcctgaccccatcacagcctcagcgggaccccgctctggggagggaagcggggaggggccaaagaggcaggctgaggaccacgtcttttcttcccaggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggagccgctgtggacgcgtccccaccctgcggtttctggggccccagctttctctactgcttcttccagcaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 178940 - DNA, 3344 bp, Homo sapiens
  Payload ID: 15271
  Gene Symbol: SARDH
  Gene Name: sarcosine dehydrogenase
  Uniprot ID: Q9UL12
  ENST ID: ENST00000371872
  CDS Start-End: 259-3015
agtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaa

SEQ ID NO: 178941 - DNA, 1957 bp, Homo sapiens
  Payload ID: 15271
  Gene Symbol: SARDH
  Gene Name: sarcosine dehydrogenase
  ENST ID: ENST00000427237
  CDS Start-End: 133-1957
cctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgt

SEQ ID NO: 178942 - DNA, 3216 bp, Homo sapiens
  Payload ID: 15271
  Gene Symbol: SARDH
  Gene Name: sarcosine dehydrogenase
  Uniprot ID: Q9UL12
  ENST ID: ENST00000439388
  CDS Start-End: 135-2891
ggcctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 178943 - DNA, 2367 bp, Homo sapiens
  Payload ID: 15271
  Gene Symbol: SARDH
  Gene Name: sarcosine dehydrogenase
  ENST ID: ENST00000422262
  CDS Start-End: 127-1935
ggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgccacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 178944 - DNA, 1954 bp, Homo sapiens
  Payload ID: 15271
  Gene Symbol: SARDH
  Gene Name: sarcosine dehydrogenase
  ENST ID: ENST00000616662
  CDS Start-End: 133-1557
cctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccgaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacg

SEQ ID NO: 178945 - DNA, 2788 bp, Homo sapiens
  Payload ID: 15272
  Gene Symbol: SSPN
  Gene Name: sarcospan
  Uniprot ID: Q14714
  ENST ID: ENST00000242729
  CDS Start-End: 178-909
ctctgctgcgggctccccgtggcctttggaggctcggtgagtcggctccaaatgttttccatatttgttcagcctccataattcgaataccagggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaa

SEQ ID NO: 178946 - DNA, 4348 bp, Homo sapiens
  Payload ID: 15272
  Gene Symbol: SSPN
  Gene Name: sarcospan
  Uniprot ID: Q14714
  ENST ID: ENST00000422622
  CDS Start-End: 223-645
gcacacgcgcgcactcgcagcctgtctgaagtgcagaggttcaggcggccaagggacccgcgccggtttccgcgggcgacctgcaaatcctgcccggggcccggcaggcgctgcgtcccggcgcgttggcagttggcgacccccctcgaatcccccctctgctgcgggctccccgtggcctttggaggctcggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaagccagtaactgaatccattttgatttttggttgagtttcctacacaaagaagaaaataactgagaatctggaatgttgtagtccatcctttaaagagtaagaaagtagcagttaatgctagtaaccgtgaattaggcaccactgaaagcacatcccgaatttctttaacaacaacattttatagtgaacactacaagtttttatatttaaaaattaagactctgtatatccttaaggtgctctatgctttaccagtaattcacagggtatttcaaatggtagaatcattttagcttctgtgcttcctttttctaaataatgcaacttgtaagagttgacattgtaataagctttataatagtataaccgtcaggagatatatatatatatatatacacatacacacacacacacacatatatactatacatatataaaatggggatattactattgtatgattaaatcattcttaagtccccaaggaaaaaaaatcataaacaaatagaaagaactaaacagaaaagaaagaaagaaaagatccctttgctatgagctcgctgtatattgataagtgtaagaattgtgttgcatgaataaccgctttgggctggatttgaagtattttgatgttgtgttttgcaaatattgaagttacaataatggcaacagaaaaggaacagatacacagctttacacttagcagaatgttacatttaaaatctgacaaggcgccaagatggtgactgtctcctctaaaccacgaaagagtaagatttgtgcaaccctcctcctcttccacctccttcaggagaattaaatgaatcaagactttggaaagacggggaagagccgggacttggcagtacttgaaacaggaggaatacaccagcctaaatgtacagactttgtagccgagcccactcgatcggtctgtgccttcacgtgaccaccatctgtgcctccctcgctccatccaaatttgtgtaggctgctccttggagctatgcctaaaatatagctacaccagagccctggaaactgtagtcaagtaacaggcctcactgttttttttctttggattaaaagtgtatatctctctactgaggggtttccagctttacacttctataggttgttctgacagtgagaacacattatgtacatgttttctattcatgtccagggcatgagaatcttaatattcttatacttccctttttgcatgcagtatgtctggaatatgtttataaaattttagcaaggggtgagatcaagggacaaaggtagagtggttatttaaagacaatcagaaatgaacttaaaagctgccctgcaaaaccaatcctttcctatcatgaagagtaccttcatattttctagagattgtctctgaaccgttgctacatagccataaatttctgtaaatcatgttggctatcagttcttgctattctcagagcactctatcatgtttttaggtgtatattgtgtattcaggatagcattaaaaagaactgatggcaaatgtattgactcacagtggaaacattcatttggatgaagaattagtggtttagcctttgaaatgaataccttgaatcatttcttctgattttctagtagtttattatctcaaatgattattatccccttcaaaaatactggtctgtactttggtgttgtggattcatttttctggcattgatcaaatagcaaatacaaaataaagcatttctacatgtttgaggtggttgtttttaaaggggatatgtgtaatgcagattttctttattaataaaattttcataatctctgaaaaca

SEQ ID NO: 178947 - DNA, 419 bp, Homo sapiens
  Payload ID: 15272
  Gene Symbol: SSPN
  Gene Name: sarcospan
  ENST ID: ENST00000535504
  CDS Start-End: 1-387
atgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaaatccattgtcatgacttctgagctgtttgaaagagaatgttctcagaatcaag

SEQ ID NO: 178948 - DNA, 587 bp, Homo sapiens
  Payload ID: 15272
  Gene Symbol: SSPN
  Gene Name: sarcospan
  Uniprot ID: Q14714
  ENST ID: ENST00000540266
  CDS Start-End: 95-517
attgtaccaggattgatgtgctcggtgcccagaaggcagtaagctctgctccctagcagccttggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaatt

SEQ ID NO: 178949 - DNA, 553 bp, Homo sapiens
  Payload ID: 15272
  Gene Symbol: SSPN
  Gene Name: sarcospan
  ENST ID: ENST00000538142
  CDS Start-End: 193-553
actctgcttgaacctccttaagggtattttaacttctcactctgcttgaacctccgtccttcgggacgcaaggattcagggagcttcctttcctggctgcgagggatcttcctgagcagagctctccgggttccccggctcgcggggcccggcgaagggcaggtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtct

SEQ ID NO: 178950 - DNA, 3880 bp, Homo sapiens
  Payload ID: 15273
  Gene Symbol: SASS6
  Gene Name: SAS-6 centriolar assembly protein
  Uniprot ID: Q6UVJ0
  ENST ID: ENST00000287482
  CDS Start-End: 142-2115
cccctcgtttctccctccccgcctcctccgcagaagccgagcgccaaactcaaactttatcaggacccggacctctcaggctaatcccgagggccgggcctgttgggcttttctgcacaccagccgaggcagcgagccaacatgagccaagtgctgttccaccaactagtcccgttgcaggtgaaatgcaaagactgtgaggagaggagagtaagtataagaatgagcattgaactacaatcagtttctaatccagttcacagaaaggacttagttattcgtctgactgatgacacggatccattttttttatataaccttgttatatctgaggaagattttcaaagtttaaaattccagcaaggtcttctggtagacttcttagctttcccacaaaaatttatagatctccttcagcaatgtactcaagaacatgccaaagaaattccaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggaagaaaaattatcattgatgcaatcactagatgatgctactaagcaactggactttacacgaaagacattagcagaaaaaaaacaagaattagataagttacggaatgaatgggcgtcacatacagcagccttgacaaacaagcattctcaggaactgacaaatgaaaaggaaaaagccttgcaggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtggttttagaagaaaatggtgagaaaaatcaagtacaactaggaaagcttgaagctacaataaaatcattatctgcagaacttctgaaggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtatgcaaattacaagaacaattagaagctacagttaaaaaacttgaagaaagcaaacaacttctaaaaaataatgaaaagttaatcacgtggttaaataaagaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagtttaatttgcagtttacaaaaccaaatgcatcactaggagatgttcagtcaggagcaactattagtatgccttgctcaactgataaggaaaatggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaatttgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaattttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctacactttg

SEQ ID NO: 178951 - DNA, 7810 bp, Homo sapiens
  Payload ID: 15274
  Gene Symbol: SATB1
  Gene Name: SATB homeobox 1
  Uniprot ID: Q01826
  ENST ID: ENST00000338745
  CDS Start-End: 1736-4027
tttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagtcaactaataatttaatgggggcagagacggcagcgaggggtagagctagcgagggagagagcgagagaagcagccccgtccggggactcgcgctcacactcacgcacacacacaaacacacacacacctctccctgtgccacccagcaacacccggcctcgtcacaacaacaacagccgcggccgccctctatcctgcccgggggcccagccgaaagccagggcgactctagaggacgctgcccgcccccctctttcatttcgggaaactcctgatcagttttgtcggggtttctgggtttcttttcccccaaagtcctagtgccattgtggtgctcgttgtttacctcggactctggacgagtgagagcttggcgactttttggggggagggggcggggagtttgtcgctgcctaggcggtggaggtggctgggggtgccttctgatcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcatttttaaataggtatgaaatttcacaatgaaaataacctgtttggttaacattttgcttaataagtagagataggatggtcaaaagactctccgacaaaaacaaatccagtctctagcagttatgttgttagaatggattcatctgtgcttatttcacaatacttcatttatagcaatgcttttccttaagctaatgtataaatatttctaaaggccattaatagtaacaaaataagtaggggaaaaaatggaccttctgtataaaaaccccttagcttttttttttcacaagttataagtggaataagttaataactgagctcgtaagtgtatctcataactataagagctacatgaagaaaataggaataacacacctggtatttaaacacaatcttcaaaattcttgcaacattaaacatagtaaaatgccagaatataaaatgaggtgtgctaatggtcacaggattgaggccagcattacagtttggggtgatttttcttttatttgctccctcactttgtttcctagatgctagtaggggtatctgggttgcttgagataccattttgcaattgccccttctctttctgcctaccatcttctcaggccctgatgagcttattggtaggcaactgggctgctttagtgttgaacttgtactttagaaactgaagtggaatcattgaaaactttcaataaagctttaaagttccatttacttttgaagcacagctaagctcctctgaaggcagctggtttgttgcaaacttaaaattgtactgaaaagttgccactttttatttagtaagaaaacaaacattctggctcactagagttcagaaaagtaataatttgagccaaaggaatttgaattaagaaaatagaaactaggtttcatgtatttaaaaaataggaaataaaatagaaactcaaatgccatgaagttatcttcctcttccttatatcccctaagtttgggttgcaaataactttccaattcctaataacctaaattattttgaaatagtgttttcagtgaaatgatgaatgtttgaatgtttgtttggtaatcaacataacaatgctaacaaaattcccacttagattttttaacttttaaaagtcagcgtggttttgataatttgatattttaaatgcccacacatacacacacacacacacacacacacacacaagcacatgttaataaactgataggatggagtgagcaaaattgttttcagggaagatggcacattttagaaaagacttgcccagatgatcttccatattgctcccccaatgtcatttatcgctcatgccaatcctcctcttgttacctgtggctatggtaaaattcctttaacaagcttcattgtgtccaagtatttcagagacttttaaaagctgggcatgacatagcgttttgtgctgttaagaccttagcagagtcaggtagtttacgggtaatattcaaccttgtgcatctgaatctgtcatggattcccttcactcagcactttgccactaatttgtattacactctgtggccatataatacttgcacattatgcaaaaaaaaatgttgatagtatctccttgccacacaatatgcagagttgacaacctttgaaaaccaaggtaactaatatgtatgtcctagttgtgtggcgcttggtaacaaagtctgtacatattatgtataaaatgtgtattggttagcatttagtactaagaaattctgagtttaaaataagtgatttttttcaaagtagcgatatctatatctgtgtttatctaaaaatactggcttgaatagaaaacattctcagatgattcaagattgagtaaaaatgagaatcccatacattccattattaaattctgccctattcccaattgttagcatctggctgatattaaggtctttgattgtcacaatattctcaataaatgagacattctgaactgcctggtgatattttcaaaaagagcaattaaaatgtgtattccctctaatacagctgatagaactgttgtgttaaagcaagttggaaatttgcatgatagtgtggaaaccaatggaggtccaaaatattaatcatatctaaaatatcagaaaatatcaatactagtcttctttatgcatatttttgactttttaagagggcttatgaattcaatgtttcttctgaggcaatccttttaatgtaaatactaaatacttgcatgtcttttgacaaaggctaaactacaatctattaatatgcacatttttgataaaatataaagtaccctaattaaagaaattgtggtagaaggtgtatgtcctgaatactatacctgtttaacaataccaaatgttaaataaaaatagtttgaaatta

SEQ ID NO: 178952 - DNA, 594 bp, Homo sapiens
  Payload ID: 15274
  Gene Symbol: SATB1
  Gene Name: SATB homeobox 1
  ENST ID: ENST00000415069
  CDS Start-End: 96-594
aaacaacaagcaacaagaggaagccgcaggcgacaagaggaggagtgcgcgtgttgggggcccccggagaggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattga

SEQ ID NO: 178953 - DNA, 579 bp, Homo sapiens
  Payload ID: 15274
  Gene Symbol: SATB1
  Gene Name: SATB homeobox 1
  ENST ID: ENST00000444341
  CDS Start-End: 368-579
tttttgcaccattatgcattcctacttctccctctttctttaagcatggagaagcctacttaaccttattataacaataacagaataggttattaatatttaatatgcacatgattaaaatttctctcccttaaacataggtcagctgtattattactaaccggcatgtaatttttcatttaaaatattggtattctgccccatgccgtttctgaaatgcagtctactttagtagtgatttaatacacaacgtttagaaaattgtggtcggctagtgagaaaagaatttaccagtcatggataatcaattatgcatgaattcagatgtaacagatggaatctggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaagg

SEQ ID NO: 178954 - DNA, 464 bp, Homo sapiens
  Payload ID: 15274
  Gene Symbol: SATB1
  Gene Name: SATB homeobox 1
  ENST ID: ENST00000450898
  CDS Start-End: 441-464
tcctcctccgccgccgccgccgccgccgccactttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaact

SEQ ID NO: 178955 - DNA, 564 bp, Homo sapiens
  Payload ID: 15274
  Gene Symbol: SATB1
  Gene Name: SATB homeobox 1
  ENST ID: ENST00000457005
  CDS Start-End: 176-564
aaagtcctagtgccattgtggtgctcgttgtttacctcggactctggacgagacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagg

SEQ ID NO: 178956 - DNA, 4589 bp, Homo sapiens
  Payload ID: 15274
  Gene Symbol: SATB1
  Gene Name: SATB homeobox 1
  Uniprot ID: Q01826
  ENST ID: ENST00000417717
  CDS Start-End: 972-3359
cttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagagcccctctcccaccacccttgggaaaggagagtctagaggcgttttcttaccaggcctgccgacccctgcaccatggctcggtgctgctcctcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatg

SEQ ID NO: 178957 - DNA, 3755 bp, Homo sapiens
  Payload ID: 15274
  Gene Symbol: SATB1
  Gene Name: SATB homeobox 1
  Uniprot ID: Q01826
  ENST ID: ENST00000454909
  CDS Start-End: 234-2525
agagctatgacctgatttgtgacgcaccctcagaactgcagtaatggtccagctgcttcacaggcaactggtaaccacctcatttggggatgtttctgccttgctagcagtgccagagagaacttcatcattgtcacctcatcaaagactactttttcagacatctcctgtagggctagattcagagagcagcttctgatatttggagggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatg

SEQ ID NO: 178958 - DNA, 975 bp, Homo sapiens
  Payload ID: 15274
  Gene Symbol: SATB1
  Gene Name: SATB homeobox 1
  ENST ID: ENST00000440737
  CDS Start-End: 302-975
ctccttctcttccttcccttggccccgcgcgctcgctcgctcgctcctcgcctcgctctcccctttaaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgacagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttacta

SEQ ID NO: 178959 - DNA, 939 bp, Homo sapiens
  Payload ID: 15274
  Gene Symbol: SATB1
  Gene Name: SATB homeobox 1
  ENST ID: ENST00000452260
  CDS Start-End: 422-939
ttattaaagtgtttctgctgtattttgtaatgtgtttctaattgttaaaaattgggactacgtaaatgcaatttgctgttttctttttagctatacttgtaataattcttgttctaaaagtaagcccatttttccccacttagtttttttataggccagttatctttttattcatgtgtattggtacagtttccacagatcattttgttaatttgaataagaatgtaatgctatcatctagaaatatagtaacatctgtatcatatctagataggccattttacaaatacattatatttgtggagagatatctagagctaaaacatttacataggacacatatatacacgtaggtccccgcccaactataacgtgtcttctttttaaattctggcaggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacaggtg

SEQ ID NO: 178960 - DNA, 583 bp, Homo sapiens
  Payload ID: 15274
  Gene Symbol: SATB1
  Gene Name: SATB homeobox 1
  ENST ID: ENST00000414509
  CDS Start-End: 236-583
atttggggatgtttctgccttgctagcagtgccagagagaacttcatcattgtcacctcatcaaagactactttttcagacatctcctgtagggctagattcagagagcagcttctgatatttggaggatcttgtaacctcgtaatatggctcttaaaaacgcactagtattcccactttctgaagtttgtagaagctgctatatatttctgtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctg

SEQ ID NO: 178961 - DNA, 626 bp, Homo sapiens
  Payload ID: 15274
  Gene Symbol: SATB1
  Gene Name: SATB homeobox 1
  ENST ID: ENST00000493952
  CDS Start-End: 292-540
tccttcccttggccccgcgcgctcgctcgctcgctcctcgcctcgctctcccctttaaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgacagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaagatattgaaattgtgtattatgagcaccagtttggttaagtactttttgtggaaccagttagagctaatatctaaaaaaggaagaaaatgatttgtggaaccagttagagttaatatctaaaaaa

SEQ ID NO: 178962 - DNA, 1000 bp, Homo sapiens
  Payload ID: 15274
  Gene Symbol: SATB1
  Gene Name: SATB homeobox 1
  ENST ID: ENST00000491519
  CDS Start-End: 417-833
ttcgtcaccattattatttgatcagaaaggtaattctgcattcattgcttttggaaaatgcactgttaatttagagcacagcttaccttaggaccaagttcatattctacttaaatatttctgttacgactttaaataatatgagaatgtatatatttgtgtgcatttgcctgtactgtacccagtctgccttggaagcacagtgaatctcttgtgattatttattttcatggctaatatttcctcccgccacccccaagctgtatttctgaagattgttggttttccatctcttcttcttcatctttttgataggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagcatcctgagatctcaaatatgttggacaatttatttattaatggaaaaataaattttaaaaagaaactacctcgtgctcctgaagcttagcttcagtactgctctcctgaaacatgacagtcatttccgtaggaattaaatacacttaggtgtttagttgatgttcagtctgtattataaatgatattggagcaacaattacaaatctatcatgttatacaaatgtgtttttaataaactgtactttatttcacagt

SEQ ID NO: 178963 - DNA, 558 bp, Homo sapiens
  Payload ID: 15274
  Gene Symbol: SATB1
  Gene Name: SATB homeobox 1
  ENST ID: ENST00000475083
  CDS Start-End: 59-558
tattaacaaaatcatgtaagcagtagaaaggtgggttcttctgaagataaatggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtg

SEQ ID NO: 178964 - DNA, 5318 bp, Homo sapiens
  Payload ID: 15275
  Gene Symbol: SATB2
  Gene Name: SATB homeobox 2
  Uniprot ID: Q9UPW6
  ENST ID: ENST00000260926
  CDS Start-End: 414-2615
gagagagagagagagagactgagaaagtcgaactcgagcttaggtaaccaacaaacccaattactaggctttattgatactaaaaggaaaagttcccctcgtaaaatttctctgagcttattagttatttaaatcagccccagggttggacgcgtgacgccgaaggcaccttctgtcggctcctggaggtgagcagccagcgtccctgcgccgacccacagcccctcgctccgtcctgggcacttggggcgaaggcgggcgcagcgagccgagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaat

SEQ ID NO: 178965 - DNA, 2135 bp, Homo sapiens
  Payload ID: 15275
  Gene Symbol: SATB2
  Gene Name: SATB homeobox 2
  Uniprot ID: Q9UPW6
  ENST ID: ENST00000428695
  CDS Start-End: 52-1899
gcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaa

SEQ ID NO: 178966 - DNA, 6194 bp, Homo sapiens
  Payload ID: 15275
  Gene Symbol: SATB2
  Gene Name: SATB homeobox 2
  ENST ID: ENST00000443023
  CDS Start-End: 1467-3491
cgatcgccctcctatctccaaagtcgaaagtactccgcgcagttaacagagctgggagccgaggcagccgcggtcgcctcttgcgcgtcggtctgcgtctccgccggcagacgcggcacccagcgactgccttgtcgccgccgcctccgcgccgggacgagtgcgcctaggggctgggcgaggcggccgcgccctggacccgccacaaggaggaggaccagaccctgggccccggtgcccgcctgcgcccagacgcacccacccgctggccgcggccaccgcctcgcgccgcactcggttctctgccatcggtccttcgccgcctcgtgcatgaggtcctcgtcaccccgctccgaccgccgactctccccttcctcttccctcctccctgcctcccacccgcccctcgcctgtccctctgcctccttcgcagccccgccgccgttgggtcgccgtgctcacagcgattgattgattgatgtttaatttcctgccaggcggggcccccctccccccgcaacctccccagccctcctccccgccccccactcccctcttttcttgcggtggaccagtctggcttgggtttagatccatcccccccacccccatcccgaaataatccagagacttcccctacccccaccccaaattattattttgaaggcgctagatctggggaccgaaagggggagggggagaaatcggaaaccgaggacaacccaaaaggactcactttgcctgatgactcaacgcaactaataatcatctccctctcagtgtgtctctctctgcggcttgtcagtgagtccggctctggctgctggcagaggcggccgagaggggagaggctggaggtgacagcttgggcggccgccgcgtttcctcccgcgcgcggtcccgggtccctgcgtcttctcggctcttggtgttaccggtcccaccgctctggccgcgcctcctcgcgagctagccgccctgcgaaccagcagccccggctcgccgccgccgccgccgcctccgggttctcagccctttctctccagaacgggtctccttcccgaaggtgtgaaaaggctctttcagcctccttctcttcccccctcctccgccgtcccctcccccgctcgctcgggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaat

SEQ ID NO: 178967 - DNA, 5730 bp, Homo sapiens
  Payload ID: 15275
  Gene Symbol: SATB2
  Gene Name: SATB homeobox 2
  Uniprot ID: Q9UPW6
  ENST ID: ENST00000417098
  CDS Start-End: 818-3019
aaattattattttgaaggcgctagatctggggaccgaaagggggagggggagaaatcggaaaccgaggacaacccaaaaggactcactttgcctgatgactcaacgcaactaataatcatctccctctcagtgtgtctctctctgcggcttgtcagtgagtccggctctggctgctggcagaggcggccgagaggggagaggctggaggtgacagcttgggcggccgccgcgtttcctcccgcgcgcggtcccgggtccctgcgtcttctcggctcttggtgttaccggtcccaccgctctggccgcgcctcctcgcgagctagccgccctgcgaaccagcagccccggctcgccgccgccgccgccgcctccgggttctcagccctttctctccagaacgggtctccttcccgaaggtgtgaaaaggctctttcagcctccttctcttcccccctcctccgccgtcccctcccccgctcgctcgggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatga

SEQ ID NO: 178968 - DNA, 2656 bp, Homo sapiens
  Payload ID: 15275
  Gene Symbol: SATB2
  Gene Name: SATB homeobox 2
  Uniprot ID: Q9UPW6
  ENST ID: ENST00000457245
  CDS Start-End: 394-2595
agaggcgcttaagttaccaagggattagggctgatctcaggagaggtaaacgaccatccttggaacacggagcccttcttccctgcccggtatctgcgcgtgccttgggtagtccgcacaaccctccccagctccggatgccctgggatacccggacccaggagagagcgcgtcagcggggcgcagctactttgcactcgccgattctgacacaacagatagttaattggggccttcgaaatcaaggactaagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttcttt

SEQ ID NO: 178969 - DNA, 2166 bp, Homo sapiens
  Payload ID: 15275
  Gene Symbol: SATB2
  Gene Name: SATB homeobox 2
  ENST ID: ENST00000440919
  CDS Start-End: 334-714
gggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggctggagagcagcaaaccctgcctcctggatttaagggatcctcccacctcagcctccggagtagctggaaatccagcagcacgccaccatgcctggcttatttccgtatttttagtagtaatagggtttcactatattggccaggctggtctggaactcctgacctcaagtgaaatgcccacctcggcctcccaaagtactgggattacaggcgtgagccatcgcgcccagccatctttcatatatctttctaaagcaaaaaaagccaaattcttccatcatggtttcctttgggacttctagacctatagtaaacagccattcaggaagatggtttgtgcaaaaagaatgaaaataaaggcatgaaggaaaatgtatgcactagcatcttctgtctctccctctgagattttatgctctgcttcaaaaaccagtttaaaaataaaaaagatgagggcggttgcaatctgcttcattttatgcagattaggtatggccctcgggtacctgccaaattgctaatatggccttccgttgggcctgattagtgtgaacccggatcttttccattaaagcagaaatgaatttgttgggaataaggtaacaacaaaagtgatattttcactaataaccgtgggtcaggttacattaaagcagtttctcagtgtgtacctgaggcagactaccctcagcatttatgatttcctccatcctcacttggctcctctctgaggacatcgtggtttttagagaccagtgggaccgtgacctccttttataccgaagctactttgagaggtcattttcttctacattccaaatgcaaaatgttattctcatttttgtaaacacatctgtaggccttacacttgtaataacaagtatcttaaattatccagaatgaatgtttatataaggatatccactctgggcaattgaatttttggataattccaatagccattttgagtgcccctgggtgaagcattaattatcttccaaaaagataatggagacaataaatatggaactatcaagcatctcttatgactctattagaatacatttttaagaaaatattttggtaccaatgattgtattttgtgggaaaagaattagaggtttgtatgaactaagcagcaactggaagttcaaaaagacaaattgggccctatctgcagatttgggtgcctaaagacttatacaaagtaaagtcagctttgtcagttgcctaatttagcccatattgaaaatcactggagctttagcacgagcagtgtttcatgtgaagtcattttgtaacccaaattatttcttgcccatggaggagtaagaaacacatttaacagttgacattctgcatcatcatggacagaccagagagagaagtagctacacccaaaatacatacgaaagtcttttacgtgggtttgcttcccattaagtggtttatggatgaataaaatatttatttttaaaggcctta

SEQ ID NO: 178970 - DNA, 4972 bp, Homo sapiens
  Payload ID: 15275
  Gene Symbol: SATB2
  Gene Name: SATB homeobox 2
  Uniprot ID: Q9UPW6
  ENST ID: ENST00000614512
  CDS Start-End: 414-2261
gagagagagagagagagactgagaaagtcgaactcgagcttaggtaaccaacaaacccaattactaggctttattgatactaaaaggaaaagttcccctcgtaaaatttctctgagcttattagttatttaaatcagccccagggttggacgcgtgacgccgaaggcaccttctgtcggctcctggaggtgagcagccagcgtccctgcgccgacccacagcccctcgctccgtcctgggcacttggggcgaaggcgggcgcagcgagccgagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatga

SEQ ID NO: 178971 - DNA, 2020 bp, Homo sapiens
  Payload ID: 15276
  Gene Symbol: SAYSD1
  Gene Name: SAYSVFN motif domain containing 1
  Uniprot ID: Q9NPB0
  ENST ID: ENST00000229903
  CDS Start-End: 101-652
cgcaggcgcacggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagat

SEQ ID NO: 178972 - DNA, 1972 bp, Homo sapiens
  Payload ID: 15276
  Gene Symbol: SAYSD1
  Gene Name: SAYSVFN motif domain containing 1
  Uniprot ID: Q9NPB0
  ENST ID: ENST00000373249
  CDS Start-End: 254-604
ggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagat

SEQ ID NO: 178973 - DNA, 3042 bp, Homo sapiens
  Payload ID: 15277
  Gene Symbol: SAFB
  Gene Name: scaffold attachment factor B
  Uniprot ID: Q15424
  ENST ID: ENST00000292123
  CDS Start-End: 108-2855
ggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacatacccttta

SEQ ID NO: 178974 - DNA, 2650 bp, Homo sapiens
  Payload ID: 15277
  Gene Symbol: SAFB
  Gene Name: scaffold attachment factor B
  Uniprot ID: Q15424
  ENST ID: ENST00000454510
  CDS Start-End: 68-2614
gtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacagatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaa

SEQ ID NO: 178975 - DNA, 459 bp, Homo sapiens
  Payload ID: 15277
  Gene Symbol: SAFB
  Gene Name: scaffold attachment factor B
  ENST ID: ENST00000589006
  CDS Start-End: 1-459
tcaagagactcagagtcccataggtccccttctgcagctctactgttgtgcagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgc

SEQ ID NO: 178976 - DNA, 3014 bp, Homo sapiens
  Payload ID: 15277
  Gene Symbol: SAFB
  Gene Name: scaffold attachment factor B
  Uniprot ID: Q15424
  ENST ID: ENST00000592224
  CDS Start-End: 89-2839
cctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttc

SEQ ID NO: 178977 - DNA, 2842 bp, Homo sapiens
  Payload ID: 15277
  Gene Symbol: SAFB
  Gene Name: scaffold attachment factor B
  Uniprot ID: Q15424
  ENST ID: ENST00000588852
  CDS Start-End: 54-2807
ataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaaca

SEQ ID NO: 178978 - DNA, 2708 bp, Homo sapiens
  Payload ID: 15277
  Gene Symbol: SAFB
  Gene Name: scaffold attachment factor B
  ENST ID: ENST00000589863
  CDS Start-End: 172-492
gtgcagttgcaaccgggatactagaacctacgcttggtgcgcctgcgcagaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagtta

SEQ ID NO: 178979 - DNA, 3371 bp, Homo sapiens
  Payload ID: 15278
  Gene Symbol: SAFB2
  Gene Name: scaffold attachment factor B2
  Uniprot ID: Q14151
  ENST ID: ENST00000252542
  CDS Start-End: 266-3127
ctcccgccgggaactgccgggacgcatgcgagctgcagattcagcgcttgcgcgttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgca

SEQ ID NO: 178980 - DNA, 836 bp, Homo sapiens
  Payload ID: 15278
  Gene Symbol: SAFB2
  Gene Name: scaffold attachment factor B2
  ENST ID: ENST00000591123
  CDS Start-End: 1-264
gtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagccc

SEQ ID NO: 178981 - DNA, 564 bp, Homo sapiens
  Payload ID: 15278
  Gene Symbol: SAFB2
  Gene Name: scaffold attachment factor B2
  ENST ID: ENST00000590262
  CDS Start-End: 193-564
tttcacatttctgatcactaccgtcaacaccacttttccttcctgccacgttacttcaccgagcgagtaccggcaaaccgtgaaaactggattgtggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccaggtactgataagagaaacacg

SEQ ID NO: 178982 - DNA, 1298 bp, Homo sapiens
  Payload ID: 15278
  Gene Symbol: SAFB2
  Gene Name: scaffold attachment factor B2
  Uniprot ID: Q14151
  ENST ID: ENST00000591120
  CDS Start-End: 62-409
agagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtaggtggatggggaaggatttaagaacactttggaaacttcatcgttgaacttcaaagtaactccggacattgaagaatcccttttggagccaggtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgtagtagtgattcttttcatgtctaaccacgtagagtggcatttaattcccccgtccccgtgattcctccatgtgtttctacacatgaaacagatcttgtgatattttgctgcagtcattttgattaacgcagttaaggcaggataaagctgttgtcagggcacttaccacctgagaagtgactggattccagaagaggaaacagagtttctccgtgaaaattttcaacatattattccccttccggactgcgtttatctcccaccgtcagaagagattctgattttcatattggattgttctgttaaaagaaattcaaagaaatttggaagttgagctgtcattgaatggtgattgcattcggttcagcaccttggacattggaaaatcagtcagaagacccagacttgaacaaaaactcgaagaagactattgagaaccagccgcgt

SEQ ID NO: 178983 - DNA, 3988 bp, Homo sapiens
  Payload ID: 15279
  Gene Symbol: SPIDR
  Gene Name: scaffolding protein involved in DNA repair
  Uniprot ID: Q14159
  ENST ID: ENST00000297423
  CDS Start-End: 385-3132
agttgttgcctgacaacacagacgacagtaacttaattcgaaagacaatacttggaggcggcccccgctccaggcaccagcccagcagctcccccgaactccccaggagctcgcgggcgagcaacgccacagcccagagcgagctccgcggaacccccagccccggggaaggaagctcgactctccgcggggcactccttccgggctccgggcccgactaggccatccgggaggccctggagcgccggggccggagaagccctgccccccgccgaagccccgccctgcgcccgagcgcccgccaatggcagggcgcggtgcggcgcgccgaggtgggacggcggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgtagcagccgtgaccaagacatggtgccctaataccaagtgttcttgggttaaag

SEQ ID NO: 178984 - DNA, 335 bp, Homo sapiens
  Payload ID: 15279
  Gene Symbol: SPIDR
  Gene Name: scaffolding protein involved in DNA repair
  ENST ID: ENST00000517619
  CDS Start-End: 58-335
ctaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaac

SEQ ID NO: 178985 - DNA, 1848 bp, Homo sapiens
  Payload ID: 15279
  Gene Symbol: SPIDR
  Gene Name: scaffolding protein involved in DNA repair
  ENST ID: ENST00000517693
  CDS Start-End: 215-1387
ttttctcagcggctcccttgcgctcaggcctcaccctcatggctcagaaatgcacagaatcaaagtcctgcggaatggcagctgatggctgaaacaggtgaaggaaaccaagattttgagcacagaagagatgcaggcacttaactgggtgtgaaacaaattcacataatctggattgtgcagagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacct

SEQ ID NO: 178986 - DNA, 802 bp, Homo sapiens
  Payload ID: 15279
  Gene Symbol: SPIDR
  Gene Name: scaffolding protein involved in DNA repair
  ENST ID: ENST00000523814
  CDS Start-End: 47-184
cggcggcgcgctgaggaggcggtgcgctcaggcggcgctcccggagatgccccgcggcagccgcgctcggggctctaagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtaaggcttgtgcaggaatctgagacaatgtgtaaaaaaatattt

SEQ ID NO: 178987 - DNA, 1035 bp, Homo sapiens
  Payload ID: 15279
  Gene Symbol: SPIDR
  Gene Name: scaffolding protein involved in DNA repair
  ENST ID: ENST00000519661
  CDS Start-End: 5-550
ggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctg

SEQ ID NO: 178988 - DNA, 2090 bp, Homo sapiens
  Payload ID: 15279
  Gene Symbol: SPIDR
  Gene Name: scaffolding protein involved in DNA repair
  ENST ID: ENST00000519401
  CDS Start-End: 1-1493
agttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagca

SEQ ID NO: 178989 - DNA, 482 bp, Homo sapiens
  Payload ID: 15279
  Gene Symbol: SPIDR
  Gene Name: scaffolding protein involved in DNA repair
  ENST ID: ENST00000518060
  CDS Start-End: 1-288
atgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagatccagagaccaggaaccctggcagaaatcctccttccttcacttggtttccttctggctaagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgat

SEQ ID NO: 178990 - DNA, 2819 bp, Homo sapiens
  Payload ID: 15279
  Gene Symbol: SPIDR
  Gene Name: scaffolding protein involved in DNA repair
  Uniprot ID: Q14159
  ENST ID: ENST00000518074
  CDS Start-End: 172-2802
gcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcagtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaaggtaggagccaggccagagcacgcacgcactcctagctcactccaacatagcgaagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttg

SEQ ID NO: 178991 - DNA, 2745 bp, Homo sapiens
  Payload ID: 15279
  Gene Symbol: SPIDR
  Gene Name: scaffolding protein involved in DNA repair
  ENST ID: ENST00000522117
  CDS Start-End: 4-234
gagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtg

SEQ ID NO: 178992 - DNA, 1023 bp, Homo sapiens
  Payload ID: 15279
  Gene Symbol: SPIDR
  Gene Name: scaffolding protein involved in DNA repair
  ENST ID: ENST00000524033
  CDS Start-End: 4-633
gagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaac

SEQ ID NO: 178993 - DNA, 970 bp, Homo sapiens
  Payload ID: 15279
  Gene Symbol: SPIDR
  Gene Name: scaffolding protein involved in DNA repair
  ENST ID: ENST00000524006
  CDS Start-End: 513-970
cgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattc

SEQ ID NO: 178994 - DNA, 585 bp, Homo sapiens
  Payload ID: 15279
  Gene Symbol: SPIDR
  Gene Name: scaffolding protein involved in DNA repair
  ENST ID: ENST00000522222
  CDS Start-End: 5-385
ggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagaggttttggcaattatgattgaaggtgctataaacatacatttggaagtttccgtgtggagataaactttcaactcctttgagtagataccaagcagagcaactattggattgtattgatatttttcaggtaaatatccttttggttgcaaataacaggaaccaaatgtagctggttttaaaagaagagaaaattcactagaacagtactgcaaatcttgag

SEQ ID NO: 178995 - DNA, 2614 bp, Homo sapiens
  Payload ID: 15279
  Gene Symbol: SPIDR
  Gene Name: scaffolding protein involved in DNA repair
  ENST ID: ENST00000524126
  CDS Start-End: 7-552
ccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccagagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaa

SEQ ID NO: 178996 - DNA, 849 bp, Homo sapiens
  Payload ID: 15279
  Gene Symbol: SPIDR
  Gene Name: scaffolding protein involved in DNA repair
  ENST ID: ENST00000517824
  CDS Start-End: 18-416
aggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctg

SEQ ID NO: 178997 - DNA, 3311 bp, Homo sapiens
  Payload ID: 15279
  Gene Symbol: SPIDR
  Gene Name: scaffolding protein involved in DNA repair
  Uniprot ID: Q14159
  ENST ID: ENST00000541342
  CDS Start-End: 225-2762
aatggcagggcgcggtgcggcgcgccgaggtgggacggcggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctg

SEQ ID NO: 178998 - DNA, 902 bp, Homo sapiens
  Payload ID: 15280
  Gene Symbol: SCAND1
  Gene Name: SCAN domain containing 1
  Uniprot ID: P57086
  ENST ID: ENST00000305978
  CDS Start-End: 235-774
cacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgcctgtggtc

SEQ ID NO: 178999 - DNA, 1727 bp, Homo sapiens
  Payload ID: 15280
  Gene Symbol: SCAND1
  Gene Name: SCAN domain containing 1
  Uniprot ID: P57086
  ENST ID: ENST00000373991
  CDS Start-End: 1072-1611
gtgacttgctcctccttgtcttccaccacgattgtgaggcctccctagccacgtggagctctcaaaggtggagacaacccaaatgtccttcaatggatggttaaatataccatggtacatctataccatagattactactcagcaataaaaaggacaaactattgatacaagcaaccacttgggtgaatctccagggaattgtgccaagtggaaagagccaagcccaaatgattatacactatatgattccagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggccacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 179000 - DNA, 1371 bp, Homo sapiens
  Payload ID: 15280
  Gene Symbol: SCAND1
  Gene Name: SCAN domain containing 1
  Uniprot ID: P57086
  ENST ID: ENST00000615116
  CDS Start-End: 704-1243
taacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgcctgtggtc

SEQ ID NO: 179001 - DNA, 3510 bp, Homo sapiens
  Payload ID: 15281
  Gene Symbol: SCARA3
  Gene Name: scavenger receptor class A, member 3
  Uniprot ID: Q6AZY7
  ENST ID: ENST00000301904
  CDS Start-End: 21-1841
aggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagt

SEQ ID NO: 179002 - DNA, 1910 bp, Homo sapiens
  Payload ID: 15281
  Gene Symbol: SCARA3
  Gene Name: scavenger receptor class A, member 3
  Uniprot ID: Q6AZY7
  ENST ID: ENST00000337221
  CDS Start-End: 334-1734
gggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccgcgcgccggagcatgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatggtaagcatcaccttaagcacatattatgccttgagacactagccaattgtggtacatgaaaataatttataaataaataaatttacctatattaggaagatga

SEQ ID NO: 179003 - DNA, 4026 bp, Homo sapiens
  Payload ID: 15282
  Gene Symbol: SCARA5
  Gene Name: scavenger receptor class A, member 5
  Uniprot ID: Q6ZMJ2
  ENST ID: ENST00000354914
  CDS Start-End: 487-1974
gtattccagaccccattgcagaagcctccgcaactgctccaagaactttattttatacggactggcggcgagagcagctgcagttcgcatctcaggcagtacctagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactgaaagtgggcagagcccaagttcggggtcctgcacagagcacccttcctgcatccctggggtggggcacagctcggggccaccctgaccatgcctcgaccacaccccgtccagcattctcagtcctcacacctgcatcccaggaccgtgggggccggtcgtcatttccctcttgaacatgtgctccgaagtataactctgggacctactgcccgtctctctcttccaccaggttcctgcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaaactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctctggcattgggcagtcacggttaaagccaagtcatgtgtgtctcagctgtttggaggtgatgattttgcatcttccaagcctcttcaggtgtgaatctgtggtcaggaaaacacaagtcctaatggaacccttaggggggaaggaaatgaagattccctataacctctgggggtggggagtaggaataaggggccttgggcctccataaatctgcaatctgcaccctcctcctagagacagggagatcgtgttctgctttttacatgaggagcagaactgggccatacacatgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagttaaaaaaaaaaaaaaaaaaaaactaaaggtgaaagatgccacattgaacaaactaaattcccaacccggttctggcaaagaatccagttatcccttccatgaagacgcacataactctcttacttggtctttccattagggacaacataagtcttgttttacatcaaataaaaacaatgttaaaaagtgtgtgaaccttaaaaatggaagtctactagtttacatacctacttcagaggacatggaaatgaccatgggcctgcatttcagggaccaaagcaaattaggcctggcctaaaatacatcagaccttttgtaagaaagaatttcaataaagcaaaaaacatgtcacaag

SEQ ID NO: 179004 - DNA, 2934 bp, Homo sapiens
  Payload ID: 15282
  Gene Symbol: SCARA5
  Gene Name: scavenger receptor class A, member 5
  Uniprot ID: Q6ZMJ2
  ENST ID: ENST00000380385
  CDS Start-End: 424-1236
ggcggcgagagcagctgcagttcgcatctcaggcagtacctagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactgaaagtgggcagagcccaagttcggggtcctgcacagagcacccttcctgcatccctggggtggggcacagctcggggccaccctgaccatgcctcgaccacaccccgtccagcattctcagtcctcacacctgcatcccaggaccgtgggggccggtcgtcatttccctcttgaacatgtgctccgaagtataactctgggacctactgcccgtctctctcttccaccaggttcctgcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaaactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctctggcattgggcagtcacggttaaagccaagtcatgtgtgtctcagctgtttggaggtgatgattttgcatcttccaagcctcttcaggtgtgaatctgtggtcaggaaaacacaagtcctaatggaacccttaggggggaaggaaatgaagattccctataacctctgggggtggggagtaggaataaggggccttgggcctccataaatctgcaatctgcaccctcctcctagagacagggagatcgtgttctgctttttacatgaggagcagaactgggccatacacatgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagtt

SEQ ID NO: 179005 - DNA, 1945 bp, Homo sapiens
  Payload ID: 15282
  Gene Symbol: SCARA5
  Gene Name: scavenger receptor class A, member 5
  Uniprot ID: Q6ZMJ2
  ENST ID: ENST00000524352
  CDS Start-End: 384-1586
tagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctagctgtcccccaagcagccccataagtttggaggttcagaggctggagccatggctggggctcaagtgtcaaaggaggctccctaccttttttagggctctgctggtctagcaagagatgctgatagaccccaggggcactggccacatttctagaggtgtcataaacctggcggttgtgtgcatggatctggaggcttcccccggtcactcgctagcccagctggtataatctctgtgcctcagtgttctcatctataaaatagggataacaggagtctttaccttataaggtcattgtgaaaattgaatgagttaatctgtgtaaagtgcttatgatcatgctggacacctggtgagga

SEQ ID NO: 179006 - DNA, 1074 bp, Homo sapiens
  Payload ID: 15282
  Gene Symbol: SCARA5
  Gene Name: scavenger receptor class A, member 5
  Uniprot ID: Q6ZMJ2
  ENST ID: ENST00000518030
  CDS Start-End: 1-1074
atggagaacaaagctatgtacctacacaccgtcagcgactgtgacaccagctccatctgtgaggattcctttgatggcaggagcctgtccaagctgaacctgtgtgaggatgtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctag

SEQ ID NO: 179007 - DNA, 2611 bp, Homo sapiens
  Payload ID: 15283
  Gene Symbol: SCARB1
  Gene Name: scavenger receptor class B, member 1
  Uniprot ID: Q8WTV0
  ENST ID: ENST00000261693
  CDS Start-End: 128-1657
cccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaa

SEQ ID NO: 179008 - DNA, 3329 bp, Homo sapiens
  Payload ID: 15283
  Gene Symbol: SCARB1
  Gene Name: scavenger receptor class B, member 1
  Uniprot ID: Q8WTV0
  ENST ID: ENST00000339570
  CDS Start-End: 198-1718
tccggcggcgccggcgatggggcataaaaccactggccacctgccgggctgctcctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaaggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccataggacatgccccgtgttgttctaggcctttgctttctgctcgttacataaatggtgaagaagagaagcgggtaagagaacagattggagccatctaaaagttctcatcttaagtgtagatcattgcaaaggatggaattttctccgattgtcatcatcgttgatgtttgaatatgagaccatttcatcagtatttaagtgtgcccgctgggatctaactaggagaggagagggtattcactgccgaacatttcaaagaatatacgaacaagctcttttatggtcagaaatgttagcccttttccccttaaacttgtatttcctttcttcttccctcctaaaattttatctaaatgatatttatatttgatgcttttaagccttttattaatcactcctatacttgcctgcaacataaatatataagttgaagcaaa

SEQ ID NO: 179009 - DNA, 2731 bp, Homo sapiens
  Payload ID: 15283
  Gene Symbol: SCARB1
  Gene Name: scavenger receptor class B, member 1
  Uniprot ID: Q8WTV0
  ENST ID: ENST00000415380
  CDS Start-End: 127-1785
ccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaa

SEQ ID NO: 179010 - DNA, 1597 bp, Homo sapiens
  Payload ID: 15283
  Gene Symbol: SCARB1
  Gene Name: scavenger receptor class B, member 1
  ENST ID: ENST00000546215
  CDS Start-End: 64-1509
cgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctc

SEQ ID NO: 179011 - DNA, 581 bp, Homo sapiens
  Payload ID: 15283
  Gene Symbol: SCARB1
  Gene Name: scavenger receptor class B, member 1
  ENST ID: ENST00000545493
  CDS Start-End: 144-581
ctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttggtgaggctgccc

SEQ ID NO: 179012 - DNA, 1812 bp, Homo sapiens
  Payload ID: 15283
  Gene Symbol: SCARB1
  Gene Name: scavenger receptor class B, member 1
  ENST ID: ENST00000544327
  CDS Start-End: 37-1536
aacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacaggtgggctttgagtaatgagacctggtacttgcatcatccattcatcaagtcagcacccggggatgccaggttctgttaggggcgaggggacgtacagcagtagaggagacagctgagatccctgctcagggggattgaggggggctggcatcccagccggggagacagatgaaaaccaagtaaatcagcagaaaagataatttcactcatgataggagctgtgaggggttagagccaaatagaaatacagcgtgagccacgtgtgaggttttcagtttaaattttct

SEQ ID NO: 179013 - DNA, 4763 bp, Homo sapiens
  Payload ID: 15284
  Gene Symbol: SCARB2
  Gene Name: scavenger receptor class B, member 2
  Uniprot ID: Q14108
  ENST ID: ENST00000264896
  CDS Start-End: 351-1787
gccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 179014 - DNA, 1495 bp, Homo sapiens
  Payload ID: 15284
  Gene Symbol: SCARB2
  Gene Name: scavenger receptor class B, member 2
  Uniprot ID: Q14108
  ENST ID: ENST00000452464
  CDS Start-End: 61-1068
ctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacaggtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcct

SEQ ID NO: 179015 - DNA, 544 bp, Homo sapiens
  Payload ID: 15284
  Gene Symbol: SCARB2
  Gene Name: scavenger receptor class B, member 2
  ENST ID: ENST00000509994
  CDS Start-End: 58-378
cttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagagacaaagtcttgctctgttgctcatgctggaatgcagtggcatgatcatagctcactgtaacgtcaaactcctgggctcaagccatcctcccaccttagcctcccaagtagctgacactacagggaactcagaaacaaagcaaatattcaatttggagataatggaacaacaatatctgctgttagcaacaaggcctatgtttttgaacga

SEQ ID NO: 179016 - DNA, 3443 bp, Homo sapiens
  Payload ID: 15285
  Gene Symbol: SCARF1
  Gene Name: scavenger receptor class F, member 1
  Uniprot ID: Q14162
  ENST ID: ENST00000263071
  CDS Start-End: 51-2543
ggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 179017 - DNA, 2619 bp, Homo sapiens
  Payload ID: 15285
  Gene Symbol: SCARF1
  Gene Name: scavenger receptor class F, member 1
  ENST ID: ENST00000348987
  CDS Start-End: 17-2251
caccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttt

SEQ ID NO: 179018 - DNA, 3342 bp, Homo sapiens
  Payload ID: 15285
  Gene Symbol: SCARF1
  Gene Name: scavenger receptor class F, member 1
  Uniprot ID: Q14162
  ENST ID: ENST00000434376
  CDS Start-End: 27-1055
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacag

SEQ ID NO: 179019 - DNA, 2871 bp, Homo sapiens
  Payload ID: 15285
  Gene Symbol: SCARF1
  Gene Name: scavenger receptor class F, member 1
  Uniprot ID: Q14162
  ENST ID: ENST00000571272
  CDS Start-End: 48-1757
gctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttt

SEQ ID NO: 179020 - DNA, 2698 bp, Homo sapiens
  Payload ID: 15285
  Gene Symbol: SCARF1
  Gene Name: scavenger receptor class F, member 1
  ENST ID: ENST00000573852
  CDS Start-End: 16-165
accgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggca

SEQ ID NO: 179021 - DNA, 2619 bp, Homo sapiens; identical to SEQ ID NO: 179017
  Payload ID: 15285
  Gene Symbol: SCARF1
  Gene Name: scavenger receptor class F, member 1
  ENST ID: ENST00000616905
  CDS Start-End: 17-2251

SEQ ID NO: 179022 - DNA, 3443 bp, Homo sapiens; identical to SEQ ID NO: 179016
  Payload ID: 15285
  Gene Symbol: SCARF1
  Gene Name: scavenger receptor class F, member 1
  Uniprot ID: Q14162
  ENST ID: ENST00000621348
  CDS Start-End: 51-2543

SEQ ID NO: 179023 - DNA, 3342 bp, Homo sapiens; identical to SEQ ID NO: 179018
  Payload ID: 15285
  Gene Symbol: SCARF1
  Gene Name: scavenger receptor class F, member 1
  Uniprot ID: Q14162
  ENST ID: ENST00000631462
  CDS Start-End: 27-1055

SEQ ID NO: 179024 - DNA, 2698 bp, Homo sapiens; identical to SEQ ID NO: 179020
  Payload ID: 15285
  Gene Symbol: SCARF1
  Gene Name: scavenger receptor class F, member 1
  ENST ID: ENST00000633740
  CDS Start-End: 16-165

SEQ ID NO: 179025 - DNA, 2871 bp, Homo sapiens; identical to SEQ ID NO: 179019
  Payload ID: 15285
  Gene Symbol: SCARF1
  Gene Name: scavenger receptor class F, member 1
  Uniprot ID: Q14162
  ENST ID: ENST00000632317
  CDS Start-End: 48-1757

SEQ ID NO: 179026 - DNA, 3232 bp, Homo sapiens
  Payload ID: 15286
  Gene Symbol: SCARF2
  Gene Name: scavenger receptor class F, member 2
  Uniprot ID: Q96GP6
  ENST ID: ENST00000622235
  CDS Start-End: 72-2672
actccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtccca

SEQ ID NO: 179027 - DNA, 3508 bp, Homo sapiens
  Payload ID: 15286
  Gene Symbol: SCARF2
  Gene Name: scavenger receptor class F, member 2
  ENST ID: ENST00000615031
  CDS Start-End: 106-2718
ggcgcccctcctgccgccccccgcccggcctcgcactccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgaccccgcccccgcagggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcgggccgcgccccggcctcttggagcccacggacgccggcggtcccccgcgaagcgcgccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctc

SEQ ID NO: 179028 - DNA, 3248 bp, Homo sapiens
  Payload ID: 15286
  Gene Symbol: SCARF2
  Gene Name: scavenger receptor class F, member 2
  ENST ID: ENST00000623402
  CDS Start-End: 73-2688
cactccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccggctcccaggtgcccacgtgctgcgctggctggaggcagcaaggggacgagtgtgggattgcggtgtgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgaccccgcccccgcagggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtccca

SEQ ID NO: 179029 - DNA, 2801 bp, Homo sapiens
  Payload ID: 15287
  Gene Symbol: SSC4D
  Gene Name: scavenger receptor cysteine rich family, 4 domains
  Uniprot ID: Q8WTU2
  ENST ID: ENST00000275560
  CDS Start-End: 349-2076
ttttctggggccgctccagctggtgccggccacctccactcccctttgcttcttgctgtccctaaggtcggatggggacaggctggggccaccagccagctccatggacagggactttgcctctgctcaccttccagctgtggaaagaaaagaagaaacgcctgtgttgatttccatttggaagatccttcctcctcctaaacttccaggggcagacaaagtgattcgatcttggattgactgtagaagaagggacagaaagagcccagaacattcccccagatgttccaactgtgacttctccctggcgccttgatgggagcatctgaaacacccttcaccatctagatgcacaaggaagcagagatgctaattggtccccagctggatgagaagcgctgggggtggaggttgggagatgggagtgctgcccctcccttcctcccccaagccctgtctttccttctcctcctgccactggccagcgccctacagcccactccactgccctttcaagagctgaggctggtggggggccccagccgctgccggggccgcctggaagtcatgcacggtggctcctggggcagcgtctgtgatgacgactgggacgtggtggacgccaacgtagtgtgtcgccagctgggctgtggcctggcactgcccgtgccacggccccttgcctttggccaaggccgaggccccatcctgctggacaacgtggagtgccgcgggcaggaagctgcgctgagcgagtgcggcagccgcggctggggcgtccacaattgctttcactacgaggatgtggctgtcctgtgtgatgaattcttgccaacgcagcccccaacaaggaagatgttaaccagtagagcacctcctacgacactgccgaatggaaaaagtgagggcagcgtacgcctggtagggggcgcgaacctgtgtcagggccgagtggagatcctgcacagtggcctgtggggcaccgtgtgtgacgacgactgggggctgccggatgccgctgtggtctgtcgtcagctgggctgcggggcggccatggccgccaccaccaacgccttcttcggctatggcaccggacacatcctgctggacaacgtgcactgcgaaggcggcgagccccgcctggcagcctgccagagcctgggctggggtgtgcacaactgcggccaccacgaggacgcgggcgcgctctgcgcaggcctgggtcccccaacgctcacagcactgccatcctcagccacaagagaggactgggcttggcagacagatccgtccgctacaggagttggcccccagccttcccgggagacagcactgctcaccaccgccgcctgggccgcggggaagaaaagtggacggctgcgactggtgggcggcccgggtccgtgccgcggccgcgtggaggtgttgcacgccgggggctggggcaccgtgtgcgacgatgactgggactttgcggacgcgcgcgtggcctgccgcgaagcgggctgcgggcctgcgctgggcgctacgggactgggccacttcggctacggccgcggccccgtgctgctggacaacgtgggctgcgccggcaccgaggctcgcctgagcgactgcttccacctgggctggggccagcacaactgcggccaccacgaggacgcgggagcgctctgcgcaggcccagaggagctgggactgcaagtccagcaggatggttctgagaccacgcgggtgcccactcctcggcccagggacgggcatctacgtctggtcaatggagcccaccgatgcgagggacgtgtagagctctacctagggcaacggtggggcactgtctgtgatgatgcttgggacctgcgggcagccggtgtcctgtgccgccagctgggctgtggccaggccctcgcagcccctggcgaggctcactttggcccaggccgaggccccattctcctggacaatgtcaagtgccgtggggaagaaagtgctctgctgctctgctctcatatccgctgggatgcccacaactgtgaccacagcgaggatgccagtgtcctgtgccagccttcatgacccagcccgctctgcagaccacctcttcttctgggagctgtgacctcccttcctcctccaggaagccctcctcttgtgatgactacagttcactttgcccctccttcccttgcctgggagagagcctacctagacagtgcagtcctgcttgggggagcctggctgtacccccgtccacttactgcgtgacctcagcctgtcatcgactgttgtgagcccaattcagtgaaagctcctgtggttttgctcagccaaaaccaaaacgaggggaagaggatgattcctaactcttctgtttggtggggctctttttatagcaccagactctgccttccttgacctagatccaggaggctcaggggctctttaaatggggtatctcctcttcccccaacccatcttgggatccccaagaagagggaaggcaggaggggcctacagctcctaccttgggccctcaggggctgcagaggaacctgggtccctgtcctgccctgctccgcgagggcctggactaactcagatggtgctcggctggacaaggggactgggggaggggccaaagcagggacagtggcccctccctgcagctggaaccagcatctctgatttatgccgtctccaccacagagcctccactttgcaggagtgaagaaccctgggggcctgtagccaccagttcataggtgccaagtcaataaagcattgtcccccgtctcttataa

SEQ ID NO: 179030 - DNA, 4845 bp, Homo sapiens
  Payload ID: 15288
  Gene Symbol: SSC5D
  Gene Name: scavenger receptor cysteine rich family, 5 domains
  Uniprot ID: A1L4H1
  ENST ID: ENST00000389623
  CDS Start-End: 24-4745
catcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactctgagagtccatggagacacaggttccccgaggaaaccgtggcccgagcgccggccaccgcggcccgctgcgaccaggacagcgcccccaaccccgtccccaggtccctccgcctctccgggacccccaggcccagcgctgacctctgactccagtcgagagctcactccccactcagccttgacgtccgaggcgacctctgacgctccggacacttcaccacccaccccagacccggcctcccggacgaaccccgacctcatcttgacaagccctgactttgctttgtccacccctgactccagtgtggttcccgcgttgaccccggagccctcacccacgcccttacccaccttgcccaaagagctgacctctgacccttctacaccgtcggaggtgaccagcctttcccctacctcagagcaggtcccagaatctgacacaaccccagatttggacacaactccatactccagtacagtctcagaatattctagatccccagacccctccccaagccctcaccccactactacccctgatcccaccatggcccctgaccccatcacaacccttaaccctactgtgacccctcacttccctaccacccctcaccccaccacgacccctcaccccaccaccatcactcactccaccatgattcctgaccccaccacaacccctcaacccttcaccaccatcactcactccaccatgattcctgaccccaccacaacccctcaacccttcaccaccatgcagcccaccacaacccctcactccacaacccctcaccccaccacgacccctcatcccaccaccatcactcactccaccatgattcctgaccccaccacaacccctcaacccttcaccaccatgcagcccaccacgatgcctcatcccaccacgacccctcaccccaccacgactcctcaccccaccacaacccctcaccccaccacaacccctcaccccaccatgactcctgaccccaccacgaccccttaccccaccactactcctgatcccaccacgacccctcaccccacaactcctgacccttcctcaacccctgtcatcactactgtgtcccttccaacctccttggggacagaactctcctctcccactctagcaccaacagtcaagcccagtctgcacccccagttgaccttcacagcacctgcccctcacacctccacatcccagatacccaccttagagccctctccagccttggagtccagcccctccaggtcctccacagccacaagcatggacccactgtccactgaggacttcaagccacccagaagccagagccccaacctaacccctccacccacccataccccacactcagcctctgaccttactgtgtcccctgaccccctcctttcccccacagcccaccccttggatcatcctccccttgaccccctcaccctagggccaactcctggtcagagcccaggcccccatggtccatgtgtggccccaacaccacctgtaagggtcatggcttgtgagccacctgccctggtggagctggtggctgctgtgagggatgtgggtggtcagctgcagagactgacccaggtcgtggaacaggagcggcaggagcgccaagccctgctgctggggctgacgcagctggtagaagctgcccggggtctggggcagctgggtgaggctgtgaagagactggcagagatggcctggaccaccagcatgcctgcaccaaccaccactaccccagaggaagaagaaagacccctgaggggagacgtgtgaccctctccaggatttgaggggcttaagacacccccaaccaaaaaaaacaaaaacaaaaaaaacccccaaagtatctaattaaaaacaaggtgtgaatggt

SEQ ID NO: 179031 - DNA, 3017 bp, Homo sapiens
  Payload ID: 15288
  Gene Symbol: SSC5D
  Gene Name: scavenger receptor cysteine rich family, 5 domains
  Uniprot ID: A1L4H1
  ENST ID: ENST00000587166
  CDS Start-End: 24-2879
catcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacagagccggaagcgggagctccgagaggtgatgctcctcgttcaaggactgccagggttgcagcgcctccctagcccatagcgccccctcgtggtggaggcgggcacgtgccgggcacagcggctgcggagacagcgggtccggcctcgggacccctcccgtagggtagggaggcagccaatgagcagaaataaatgcagaatcacaaactg

SEQ ID NO: 179032 - DNA, 354 bp, Homo sapiens
  Payload ID: 15288
  Gene Symbol: SSC5D
  Gene Name: scavenger receptor cysteine rich family, 5 domains
  ENST ID: ENST00000589020
  CDS Start-End: 1-354
gacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggcccca

SEQ ID NO: 179033 - DNA, 457 bp, Homo sapiens
  Payload ID: 15288
  Gene Symbol: SSC5D
  Gene Name: scavenger receptor cysteine rich family, 5 domains
  ENST ID: ENST00000594321
  CDS Start-End: 187-457
gtcccctgccgcctccctgcagcctctttcttcctcctggcaaagcgtccagccctgcctgctcctcctcgggcctgggcgcctccagcaggcacttccctccctccctctctccccagctgcctcctcctcttctctccccgctctccttcccctttcaccccatcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggg

SEQ ID NO: 179034 - DNA, 3016 bp, Homo sapiens
  Payload ID: 15288
  Gene Symbol: SSC5D
  Gene Name: scavenger receptor cysteine rich family, 5 domains
  ENST ID: ENST00000615233
  CDS Start-End: 24-2885
catcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacagagccggaagcgggactccgagaggtgatgctcctcgttcaaggactgccagggttgcagcgcctccctagcccatagcgccccctcgtggtggaggcgggcacgtgccgggcacagcggctgcggagacagcgggtccggcctcgggacccctcccgtagggtagggaggcagccaatgagcagaaataaatgcagaatcacaaactg

SEQ ID NO: 179035 - DNA, 4910 bp, Homo sapiens
  Payload ID: 15289
  Gene Symbol: SLFN11
  Gene Name: schlafen family member 11
  Uniprot ID: Q7Z7L1
  ENST ID: ENST00000308377
  CDS Start-End: 154-2859
gcttcggaagcgctggagcttgagaggtcagagagggtccttgcccccagcctgggactccggagttgcgtttctacccgtgcttcagggtctagcccagccgaatccgcgtcgggctgtaactcgagtgccagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 179036 - DNA, 5030 bp, Homo sapiens
  Payload ID: 15289
  Gene Symbol: SLFN11
  Gene Name: schlafen family member 11
  Uniprot ID: Q7Z7L1
  ENST ID: ENST00000394566
  CDS Start-End: 274-2979
aaacgctaagggggcttcggaagcgctggagcttgagaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 179037 - DNA, 791 bp, Homo sapiens
  Payload ID: 15289
  Gene Symbol: SLFN11
  Gene Name: schlafen family member 11
  ENST ID: ENST00000441608
  CDS Start-End: 457-791
atctcctgcgtgggatgtgcgtgggatggcgccaacccgctagtatataaggactcgacctgggcgcctccagggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcag

SEQ ID NO: 179038 - DNA, 714 bp, Homo sapiens
  Payload ID: 15289
  Gene Symbol: SLFN11
  Gene Name: schlafen family member 11
  ENST ID: ENST00000427966
  CDS Start-End: 444-714
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgc

SEQ ID NO: 179039 - DNA, 606 bp, Homo sapiens
  Payload ID: 15289
  Gene Symbol: SLFN11
  Gene Name: schlafen family member 11
  ENST ID: ENST00000430814
  CDS Start-End: 335-606
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgca

SEQ ID NO: 179040 - DNA, 634 bp, Homo sapiens
  Payload ID: 15289
  Gene Symbol: SLFN11
  Gene Name: schlafen family member 11
  ENST ID: ENST00000591682
  CDS Start-End: 266-634
ggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccc

SEQ ID NO: 179041 - DNA, 1124 bp, Homo sapiens
  Payload ID: 15289
  Gene Symbol: SLFN11
  Gene Name: schlafen family member 11
  ENST ID: ENST00000592108
  CDS Start-End: 1-152
atatctgccgagcagagacccggaaaactttcctaagagaaaactttgaacacattcaacacatcgtcattgacgaagctcagaatttccgtactgaagatggggactggtatgggaaggcaaaaagcatcactcggagagcaaaggaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattg

SEQ ID NO: 179042 - DNA, 588 bp, Homo sapiens
  Payload ID: 15289
  Gene Symbol: SLFN11
  Gene Name: schlafen family member 11
  ENST ID: ENST00000592122
  CDS Start-End: 443-588
tcttgcatctcctgcgtgggatgtgcgtgggatggcgccaacccgctagtatataaggactcgacctgggcgcctccagggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggc

SEQ ID NO: 179043 - DNA, 584 bp, Homo sapiens
  Payload ID: 15289
  Gene Symbol: SLFN11
  Gene Name: schlafen family member 11
  ENST ID: ENST00000589811
  CDS Start-End: 284-584
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaa

SEQ ID NO: 179044 - DNA, 575 bp, Homo sapiens
  Payload ID: 15289
  Gene Symbol: SLFN11
  Gene Name: schlafen family member 11
  ENST ID: ENST00000588579
  CDS Start-End: 336-575
aaacgctaagggggcttcggaagcgctggagcttgagaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtct

SEQ ID NO: 179045 - DNA, 2383 bp, Homo sapiens
  Payload ID: 15290
  Gene Symbol: SLFN12
  Gene Name: schlafen family member 12
  Uniprot ID: Q8IYM2
  ENST ID: ENST00000304905
  CDS Start-End: 378-2114
tttgtaacttcacttcagcctcccattgatcgctttctgcaaccattcagactgatctcgggctcctatttcatttacattgtgtgcacaccaagtaaccagtgggaaaactttagagggtacttaaaccccagaaaattctgaaaccgggctcttgagccgctatcctcgggcctgctcccaccctgtggagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaa

SEQ ID NO: 179046 - DNA, 2539 bp, Homo sapiens
  Payload ID: 15290
  Gene Symbol: SLFN12
  Gene Name: schlafen family member 12
  Uniprot ID: Q8IYM2
  ENST ID: ENST00000394562
  CDS Start-End: 525-2261
gagggccggaaaacagaaaaggattcgcgttctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggagccatctctagaatgtcaaatggtctctcttcaactggaatgatgagaagtgaaacaaatatgcgaccatgaggacactgtaacctatggatggtgtgctgagactggaaacccaaaatgatgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttgaactgggaaaa

SEQ ID NO: 179047 - DNA, 2423 bp, Homo sapiens
  Payload ID: 15290
  Gene Symbol: SLFN12
  Gene Name: schlafen family member 12
  Uniprot ID: Q8IYM2
  ENST ID: ENST00000452764
  CDS Start-End: 420-2156
aaagagtgcggacacttccggagcgccagctgcccaatagaaatgcaggccacgctggggaagtgtggagccgcagcccaggatggggagggccggaaaacagaaaaggattcgcgttctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctggtctgcggattaccaccttgagctccaatttgtacaaaagagatataacatctgcaaaagtcatgaatgccactgctgcactggagttcctcaaagacatgaaaaagactagagggagattgtatttaagaccagaattgctggcaaagaggccctgtgttgatatacaagaagaaaataacatgaaggccttggccggggttttttttgatagaacagaacttgatcggaaagaaaaattgacctttactgaatccacacatgttgaaattaaaaacttctcgacagaaaagttgttacaacgaattaaagagattctccctcaatatgtttctgcatttgcaaatactgatggaggatatttgttcattggtttaaatgaagataaagaaataattggctttaaagcagagatgagtgacctcgatgacttagaaagagaaatcgaaaagtccattaggaagatgcctgtgcatcacttctgtatggagaagaagaagataaattattcatgcaaattccttggagtatatgataaaggaagtctttgtggatatgtctgtgcactcagagtggagcgcttctgctgtgcagtgtttgctaaagagcctgattcctggcatgtgaaagataaccgtgtgatgcagttgaccaggaaggaatggatccagttcatggtggaggctgaaccaaaattttccagttcatatgaagaggtgatctctcaaataaatacgtcattacctgctccccacagttggcctcttttggaatggcaacggcagagacatcactgtccagggctatcaggaaggataacgtatactccagaaaacctttgcagaaaactgttcttacaacatgaaggacttaagcaattaatatgtgaagaaatggactctgtcagaaagggctcactgatcttctctaggagctggtctgtggatctgggcttgcaagagaaccacaaagtcctctgtgatgctcttctgatttcccaggacagtcctccagtcctatacaccttccacatggtacaggatgaggagtttaaaggctattctacacaaactgccctaaccttaaagcagaagctggcaaaaattggtggttacactaaaaaagtgtgtgtcatgacaaagatcttctacttgagccctgaaggcatgacaagctgccagtatgatttaaggtcgcaagtaatttaccctgaatcctactattttacaagaaggaaatacttgctgaaagccctttttaaagccttaaagagactcaagtctctgagagaccagttttcctttgcagaaaatctataccagataatcggtatagattgctttcagaagaatgataaaaagatgtttaaatcttgtcgaaggctcacctgatggaaaatggactgggctactgagatatttttcattatatatttgataacattctctaattctgtgaaaatatttctttgaaaactttgcaagttaagcaacttaatgtgatgttggataattgggttttgtctattttcacttctccctaaataatcttcacagatattgtttgagggatattaggaaaattaatttgttaactcgtctgtgcacagtattatttactctgtctgtagttcctgaataaattttcttccatgcttg

SEQ ID NO: 179048 - DNA, 751 bp, Homo sapiens
  Payload ID: 15290
  Gene Symbol: SLFN12
  Gene Name: schlafen family member 12
  ENST ID: ENST00000447040
  CDS Start-End: 406-751
ggggagggccggaaaacagaaaaggattcgcgttctttttactctgtggagagtgagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagttatacaaaagatggaataggactagatttggaaaattcttttagtaacattctgttatttgttcctgagtacttagacttcatgcagaatggtaactactttctgatttttgtgaagtcatggagcttgaacacctctg

SEQ ID NO: 179049 - DNA, 702 bp, Homo sapiens
  Payload ID: 15290
  Gene Symbol: SLFN12
  Gene Name: schlafen family member 12
  ENST ID: ENST00000445092
  CDS Start-End: 495-702
gagcccgcggactgtagcctgggcctcgccaagttcctttgttctttgttttctttaaattaccttttttctttttgtcttaaaaaatacacatgggtgaaaaagaaacgagagctccctagagatcactcagagctgttttcgtgggtttttaacttccagttgctcaagggtccacgctggcatctggggtgtgctcgcacctgcgaagaatccagcttctagggagcaccgcgagctgttctttgttcaacacgccaagaacctggacactcttcactggtaacatattttggcaagccaaccaggaggttttcgatgtttgcatgcagccatctctagaatgtcaaatggtctctcttcaactggaatgatgagaagtgaaacaaatatgcgaccatgaggacactgtaacctatggatggtgtgctgagactggaaacccaaaatgatgaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagtgtctcacgagctatgtgtgctctgctcaattctggagggggagtgatcaaggctgaaattgagaatgaagactatagtt

SEQ ID NO: 179050 - DNA, 2752 bp, Homo sapiens
  Payload ID: 15291
  Gene Symbol: SLFN12L
  Gene Name: schlafen family member 12-like
  Uniprot ID: Q6IEE8
  ENST ID: ENST00000361112
  CDS Start-End: 880-2733
acatattccccccttgaggctagaatggcaggcctaaaatgagtaggagaattctgagaaatggaaactttaaaaaggcggcaaccttctagtttcattctcagaaataccaaagcagcatttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaagtgctaccaggatatttgcgatgtactctggaatccctctggaaggagctgtcctcacagaatgaaggattagaggagttaataaataagcaaacccaacctttctcctggggaattgtgatcctctctagaagctaggctgtggacctgaatttgcaggagaagccaggagtcatctgtgatgctctgctgatagcatagaacagccctggcagggccaggactactgcacttgcactgcccttactttgaagcagaagctggtgaacatggggggctacactggggaggtgtgtgtcagggccaaggtcctctgcctgagtcctgagagcagcgcagaggctttggaggctgcagtgtctccgatggattaccctgcgtcctatagttttgcaggcacccagcacattggaagccctgctgcagtccctcgtgattgtcttgctcggcttcaggtctctcttgagtgacctgtgcagctatgaggttttaaatctgctcacagcccagcagtatgagatattctccagaagcttccacaagaacagagaattgtttgtccatggcttacctggcttaggaaagaccatcatggccatgaagatcatggagaagatcaggaatgtgtttcactgtgaggcacacagaattctctacatttgtgaaagtcagtttctgaggaatttcatcagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccagtatgtgaggaactgccctctccagcaagtacatcatcacctgtctcccagagttatcctcttcgtgaatatattaacttcaaaattcagccactgagatatcaccttccagggctatcagaaaagataacttgtgctccaaaaaccttctgcagaaatctgttctcacaacatgaaggacttaagcaattaatatgtgaagaaatgggctctgtcaataagggctcactgatcttctctaggagctggtctttggatctgggcttgcaagagaaccacaaagtcctctgtgatgctcttctgatttcccaggacaagcctccagtcctatacaccttccacatggtacaggatgaggagtttaaagactattctacacaaactgcccaaactttaaaacagaagctggcaaaaattggtggttacactaaaaaagtgtgtgtcatgacaaagatcttctacttgagccctgaaggcaagacaagctgccagtatgatttaaactcgcaagtaatttaccctgaatcctactattggacaacagctcaaacaatgaaagacttggaaaaggccctttcaaatatcttacctaaggagaatcaaatctttttgtttgtttgtttgtttcgtttttgtttgtttgtttgttggtttgtttgttttttcttgagatgagtctcactctgtcacccag

SEQ ID NO: 179051 - DNA, 3119 bp, Homo sapiens
  Payload ID: 15291
  Gene Symbol: SLFN12L
  Gene Name: schlafen family member 12-like
  Uniprot ID: Q6IEE8
  ENST ID: ENST00000260908
  CDS Start-End: 119-1885
ggggagtcgagtgcccgatagaaatgcagctgagcgaggggctagccgcacacggacgcggagagcaggaaagtggaaaagaactcaggtccccctacttggtgaagagtgcgcagacatggacctcgccagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccagtatgtgaggaactgccctctccagcaagtacatcatcacctgtctcccagagttatcctcttcgtgaatatattaacttcaaaattcagccactgagatatcaccttccagggctatcagaaaagataacttgtgctccaaaaaccttctgcagaaatctgttctcacaacatgaaggacttaagcaattaatatgtgaagaaatgggctctgtcaataagggctcactgatcttctctaggagctggtctttggatctgggcttgcaagagaaccacaaagtcctctgtgatgctcttctgatttcccaggacaagcctccagtcctatacaccttccacatggtacaggatgaggagtttaaagactattctacacaaactgcccaaactttaaaacagaagctggcaaaaattggtggttacactaaaaaagtgtgtgtcatgacaaagatcttctacttgagccctgaaggcaagacaagctgccagtatgatttaaactcgcaagtaatttaccctgaatcctactattggacaacagctcaaacaatgaaagacttggaaaaggccctttcaaatatcttacctaaggagaatcaaatctttttgtttgtttgtttgtttcgtttttgtttgtttgtttgttggtttgtttgttttttcttgagatgagtctcactctgtcacccagactggagtgtagtgacacgatctcgactcactgcaacctctgcctcctgggttcaagcaattccctgcctcagcctcccgagtagctgggattacatgtgcctgccaccacacctggctaatttttttttttttgtatttttagcagagatggggtttcaccgtcttggccaggctggtcttgaactcctgacctcgtgattcaacccccccccccggtctcccaaagtgctaggagtacagatgtgagccaccgcgcccggctggagaatcaattcttttatagaccaattagcctttgacatttccagcatctcccagataatcagtatagataaggatgtttaaatcttgtccaaggctcacttgaatcatggaagatggactgggctacagagatatttttcattatatatttggtaacattctctaattctctaaaaatacgtctttgaaaacattgcaagttaggcaacttgacgtgatgttggaaaactgggattagcctatgttcgcttcttcctaagttctttatagatattccttaagggaaattagaaaaattaattacctacacatgttttgccataccaagatgtcatttgactataaaggaaatatcagacattcttatccaatggacatggaaaacatagttctctaatatcttcttgaaaactatattgcaatgaaatgcagccaatgaagagatgaatcaaaatggagaacttgccgagttggatggatcacttgaggtcaggagttgaagaccagcctgggcaacatggtgaaacccagtctctactaaaaatataaaaattagccaagtgtggtggcacacacatgtagtcccagctactcgggaggctgaggcatgagaattgcttgaacgcaggaagtggaggttacagtgagccaagaccacaccactgcactccagcttgggcaagagagcaagactctgtcatctctatgcaaataaactagaaaatctagaagaaatggataaattcctgaacacatgcaacctcccaagactgagccagggagaagtcaaatccctgaacaggtcaataacaagttctgaaattgaggcagtaattactaaccaaaaaaagcccaggaccagacagattcacagctgaattctaccagaggtacaaagaggagctggtaccatttctactgaaactattccaaacaataaaagaggaaa

SEQ ID NO: 179052 - DNA, 1767 bp, Homo sapiens
  Payload ID: 15291
  Gene Symbol: SLFN12L
  Gene Name: schlafen family member 12-like
  ENST ID: ENST00000628453
  CDS Start-End: 1-1767
gatttacttaaaagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccagtatgtgaggaactgccctctccagcaagtacatcatcacctgtctcccagagttatcctcttcgtgaatatattaacttcaaaattcagccactgagatatcaccttccagggctatcagaaaagataacttgtgctccaaaaaccttctgcagaaatctgttctcacaacatgaaggacttaagcaattaatatgtgaagaaatgggctctgtcaataagggctcactgatcttctctaggagctggtctttggatctgggcttgcaagagaaccacaaagtcctctgtgatgctcttctgatttcccaggacaagcctccagtcctatacaccttccacatggtacaggatgaggagtttaaagactattctacacaaactgcccaaactttaaaacagaagctggcaaaaattggtggttacactaaaaaagtgtgtgtcatgacaaagatcttctacttgagccctgaaggcaagacaagctgccagtatgatttaaactcgcaagtaatttaccctgaatcctactattggacaacagctcaaacaatgaaagacttggaaaaggccctttcaaatatcttacctaaggagaatcaaatctttttgtttgtttgtttgtttcgtttttgtttgtttgtttgttggtttgtttgttttttcttgagatga

SEQ ID NO: 179053 - DNA, 8469 bp, Homo sapiens
  Payload ID: 15292
  Gene Symbol: SLFN13
  Gene Name: schlafen family member 13
  Uniprot ID: Q68D06
  ENST ID: ENST00000285013
  CDS Start-End: 277-2970
atcccctgtgtgggacctgcccaggtaggcgccaaccattggttataagaacctgaccttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtcacatcttttgtttcacgaattaacagtcaacacctggccctacttttaacaaaacttagtaaagccttgagcatagtgaaagacaaatatttaaattatatattagcaggaggctgaggtgggaggatcatatgaggccagcctgggcagcatagcatgacccccccctcgagaagacaacaaaaaattatctgggtgtggtggtgtgctcctgcagtcctagctattccagaggccgaggcgagaggatcgcttgattccaggagttcaaggctgtagttagcgataatcgtgtcactgaatcctagcctgggcaacagaataagaccccatgtctaacaaaataataataaaacaatcaaaagtttaaaattagttattaaatgtcagtgtgcccagagtcctttgaccacagatgatcctgatggccttctctcgccttgtccctgtgcctccttctaccatttttcttcctgagattcaaaagtaagtagcggacagggttcccatttaccactaaatacttcagtgggtgtttcctaaaaggacatttatagtaccatcatcaaaatcagtaaattaaccctgatactattatctaatctgtagactttattgaattatatcagttgtgcctcaagtgtctttatgtttttttctcaaaagagaaaaagttctggtccaggatttgatctaagatcatgcattgtattgagctttcctttcttttaagtctcatttaatctggagatgttaatctgtctttgtcatatctttgacactattgaagaggactggcctattattttgcagagtatctgattttgggtcatttcatgtgttctcatgattagattcaggttatgcatttttggcatgaattccatagaagggctgttacggttctcagttcacggtattagaaggcacttgatagtgattagttccattcctgatgatgttaactctgatcatttggataaagtggcgtctgccaggtttccctactgtgcagttacaatttgctttttgtaattaataaagtgtgtgtgtgtgtgtgtgtggagggggggtgtttttgcttctgaacgcataatatttgagatttttttctaattaaaaagtaattattcaaagagttcagagaactgatactgatcacattctttgaccccacatgcaaatacattataaactagtaataaaacggtaactagaaaaatgttcatatcttttggaattaaaaaagtgtttaactcgtggatcaaagcagaaattctgtaaccattgtcacagcaggttctaacaagcaagtttaaggaggagagaatttcagtcctagagaatttcagtcttattcaaatgctttcctagaaagaggaaacagttcctaactaatttcatgaggctggcataatcttgataacaagtctgataggtaaagtatgaaaggaaaattgcaggtcactcaattatcactcaaatatctacatgaaaaattctaaacaaaattttagcaaacaaaatccaacaatttgtaaaagtgataatacaccacgaccaaggtggttcaagtcaggaattcaacgttgattttggcgttaaaaaatcaatcatcaggcccagtgaggtggctcactcctgtaatcccagactttctggaggctgaaggaggaaagatccttcaggccagaagtttgagtctgcactgagctgtgactgcatcaccgcactctagcctgggtgccagtttgagaccctgtctccaagaaaaaaaaattaatcagtgtaattcaccacagattaagagttcaaaagagaaaaatcacatgatcatctgaatagaggaaaaagcttttgataaagttcaacatccattcataataaggactctcagcaacttagaagtataaaaacacttttggaaatcaacaaagggaatttacagcatgaacaaacagcaagccagcatggtggctcacacctgtaatctcagcacttccagaggccaaggcaggagaatcacttgagcccaggggttagagacaagccttggcaacatagcaagatcctggctctacaaaaaataaaataaaatgaaataaaatttaaaaattagctgggtttggtggtgtgtgcctgtagtcccagctactgggaggctgaggtgagaggatcactggagcccaggaggtgaaggctgcagtgggctaaaaacaaccagaacaaccccccaaccccctccccgcaaaacactataaagaatagcaacacaaggttcaatgtaaactttgatatggtgttttacctctgaggagaggcttattgttaatattctttagccgtgtaaggggttcacagatgttcatacttttgttctttataccttatatgtattctataaatattgtttctactcaatagttaataaaaacataatttaaaagttc

SEQ ID NO: 179054 - DNA, 576 bp, Homo sapiens
  Payload ID: 15292
  Gene Symbol: SLFN13
  Gene Name: schlafen family member 13
  ENST ID: ENST00000524511
  CDS Start-End: 258-576
aaaacagaaagcccctgcccagcgagcagcggtttccgcgggggcggaacaaacaggcagagccaagtgcgtcctggaggcttcccccgttgcgaaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttata

SEQ ID NO: 179055 - DNA, 6004 bp, Homo sapiens
  Payload ID: 15292
  Gene Symbol: SLFN13
  Gene Name: schlafen family member 13
  Uniprot ID: Q68D06
  ENST ID: ENST00000526861
  CDS Start-End: 259-2952
accttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtacttcaggactgattttggtgtaagaagacagcaggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtcaca

SEQ ID NO: 179056 - DNA, 596 bp, Homo sapiens
  Payload ID: 15292
  Gene Symbol: SLFN13
  Gene Name: schlafen family member 13
  ENST ID: ENST00000532210
  CDS Start-End: 205-596
aaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattgctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctct

SEQ ID NO: 179057 - DNA, 3058 bp, Homo sapiens
  Payload ID: 15292
  Gene Symbol: SLFN13
  Gene Name: schlafen family member 13
  Uniprot ID: Q68D06
  ENST ID: ENST00000534689
  CDS Start-End: 204-1943
aaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctggctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaa

SEQ ID NO: 179058 - DNA, 3910 bp, Homo sapiens
  Payload ID: 15292
  Gene Symbol: SLFN13
  Gene Name: schlafen family member 13
  ENST ID: ENST00000530782
  CDS Start-End: 277-636
atcccctgtgtgggacctgcccaggtaggcgccaaccattggttataagaacctgaccttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagcc

SEQ ID NO: 179059 - DNA, 5921 bp, Homo sapiens
  Payload ID: 15292
  Gene Symbol: SLFN13
  Gene Name: schlafen family member 13
  Uniprot ID: Q68D06
  ENST ID: ENST00000542635
  CDS Start-End: 178-2871
gtggaagaagacagcaggcggtgggcattcactgtgctggtgggaagtctggttacattaagaaaggaattctagcaaagttattctgtaaatacaacagaatcagttgcttttgttaaatatattggtacttcaggactgattttggtgtaagaagacagcaggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcataactacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagccatccagtctctagtgttttgttattgcagcctgagaacacagctgtatgatcattcatcaaactaaaaacactgatacttaacaatgctaatgcaattacttatttgcttttcagtctctacaaaacattctaaaacactaatctaaatactaacaataaaatatttgcataactaatgaaaattaagaaaccacatgcccaatattccatttataagtaatcctatttggctgatttccctccatattgtaagttttgaacttttctgccagtctttctcctatttgtgttaactcatggaattccagttgtctagccttgaaattgtaggctcttctaacttgagcaaaatctgacagatcagcaaaataaggagaaaaatatttcttctttctttctggctgcattaaatgagatacagctcagcaccaaaaagctatctttgtaaatgttcttagtaaactccctggtctttggagttatttcagcctttgagagtaattctttaaaagtctaattctgactggttgaatctctctatatgatttattgccctagtaatatttgaaacagtatcatattttaaaatatataaatatttatgaatttttgttcagcccaaagaggattactgatgctttcttctttttccatatgatgaggaaatgtttagcttatatatttattgcatttctgttttaaataaaaaattgagagtttgtgtttcattaaactgaaaaaaaaggttctgtaaaataaatgattaaatggaggaaaaggagaagactgaggccagcaactccatgatacagccaaaaatgagccagtaaaagattaagcaagattaactgtaaattttttttttttttttttttaaagagaaaaggtctcactgtgtttcccaggctggagggtagtggtgtgatcatagttcactagagccctgaactcctgggctcaagtgatcctcttgccttagcctcccattgctgggattataggcatgagccactgtgtcaggcttaattgggttttgatgggtacctgcctatctctgtaatttggctctagtcatataggacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaattccaggaatgctcacagatctgtccttgtagtctcctgccacttcttgctatggagtgctgtaccaaggtctctgctagtttctagttggcttgacataatgactttcctaaacttcttctgctctgaatctcaagcatggaaagcggtca

SEQ ID NO: 179060 - DNA, 4121 bp, Homo sapiens
  Payload ID: 15292
  Gene Symbol: SLFN13
  Gene Name: schlafen family member 13
  Uniprot ID: Q68D06
  ENST ID: ENST00000533791
  CDS Start-End: 331-3024
gtgcatcttttaagtcttggcctaaatggaacctactcctggaagtcttatggaaccatggtctccagattcgttcagataccctattcaatgtgttttccctcttagagcccatgtcacagatgatggtaaaggctaatttcattagttcccttccctgccagccagtcagctcctaaagagactatacctgtctttcttgctattgtcttatcccagcacatattagacacgttttaaatattttctaataaatgaattgcaggcctgtaacaattttttaatcaaaaatgaaacaaatattctaatactttaaggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcctgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattttctttaaaaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctc

SEQ ID NO: 179061 - DNA, 550 bp, Homo sapiens
  Payload ID: 15292
  Gene Symbol: SLFN13
  Gene Name: schlafen family member 13
  ENST ID: ENST00000531588
  CDS Start-End: 318-550
ctgaccttggcgcctccagggaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtaacttgacaaagatgtttcagtggtctcggaatgcaagacagaatcctgacggtagaaatttctaggcaagggtctaaattaggcaaactggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactgga

SEQ ID NO: 179062 - DNA, 2889 bp, Homo sapiens
  Payload ID: 15293
  Gene Symbol: SLFN14
  Gene Name: schlafen family member 14
  Uniprot ID: P0C7P3
  ENST ID: ENST00000415846
  CDS Start-End: 37-2775
ttcttttattgtttggagcacagaggggctgctgaaatggagagtctcaagactgatactgaaatgccgtatcctgaggtaatagtagatgtgggcagagtgatttttggagaagaaaacaggaagaagatgaccaacagctgtttgaaaagatctgagaattctagaattatccgggctatatgtgcactgttaaattctggaggtggtgtgatcaaagcagagattgatgataaaacctatagttaccaatgccatgggctgggacaggatttggaaacttcttttcaaaagctccttccttcaggttcacagaaataccttgactacatgcagcaggggcacaatctcctgatttttgtgaagtcatggagcccagatgttttcagccttccactaaggatttgcagcttgcgctccaatttgtatcggagagatgtgacttctgctatcaacttgagtgctagcagtgccctggagcttctcagagagaaggggtttagagcccaaagaggaagaccaagggtgaagaagttgcatcctcagcaggttctcaatagatgcattcaggaagaggaagatatgaggatattggcctcagaattttttaaaaaggacaaactcatgtataaggagaaactcaactttactgagtcaacacatgttgaatttaaaaggttcaccaccaaaaaagtcatacctcggattaaggaaatgctgcctcattatgtttctgcatttgccaacactcaagggggatatgtcctcattggggtggatgataagagcaaagaagtggttggatgtaagtgggaaaaagtgaatcctgacttactaaaaaaagaaatcgaaaactgcatagaaaaattgcctacattccacttctgctgtgagaagccaaaggtaaatttcactacaaaaatcctgaatgtgtaccaaaaagatgtcctggatggttatgtctgtgtgattcaagtggagcccttctgttgcgtggtgtttgcagaggccccagattcctggatcatgaaagacaattctgtcacacggctgacagctgagcagtgggtggtcatgatgctggatactcagtcagctcctcccagtttggtcacagactacaactcttgcctgatttcatcagcttcatctgcacgaaaaagtcccggatatcccataaaagtccacaaatttaaggaggctctgcaacgacatttgtttccagtgacacaggaagaggtacaatttaaaccagaatccctctgtaagaagctgttctcagatcataaagaactggagggtttaatgaagaccctgatacatccttgttctcaggggattgtgatattttctagaagctgggctggtgatgttggcttcaggaaagaacagaatgtcctgtgtgatgctctcctgatagcagttaacagccccgtggtactctatacaatcttaatagaccccaattggcctggaggacttgaatatgcccgaaacacagctcatcagttaaagcagaaactgcaaactgttggtggttacacagggaaagtgtgcatcattccaaggctgatacacctgagcagcacacagagtagacctggtgagatccccctgcgttaccccaggtcctacaggcttgctgatgaggaggaaatggaagacttgctgcaggctctggtggtggtctccctgtcctccagatctcttctgagtgaccagatgggctgtgaatttttcaacttgctcataatggagcagagccagttgctttctgagagtcttcagaagacacgtgaattattcatctactgctttccaggagtcaggaagacagccctagccataaagatcatggagaaaattaaggacttgtttcactgcaaaccaaaagagatcctctatgtttgtgaaagcgactccctaaaggattttgtgacccaacaaaccacctgccaagctgtgaccaggaaaactttcatgcaaggggagtttctaaagattaaacacatagtgatggatgagactgagaatttctgcagcaaatatggcaattggtacatgaaggctaagaacatcacccatccaaaggcgaaggggactggaagtgaaaaccttcaccatgggattctctggctttttcttgacccttttcaaatccatcacgcagatgtcaatggccttccccctccatctgctcagtttcctcgaaaaacaatcaccagtgggatccactgtgctctggaaatagcgaaggttatgaaagaagaaatgaagaggatcaaagaaaatcctccctccaacatgtctccagacacattagcattgttcagcgagactgcctatgaggaagcaacgtgtgcccaggctctgcctggggtgtgtgagacaaagactaatctgacaacagaacaaatagctaactatgtggcaagaaaatgtcacagcctgttccagtgtggctatctgcccaaagatatagcaattctgtgcaggagaggggaggacagaggacgctataggcttgcactactcaaagcaatggaattaattgagacccacagaccatcagaggttgtgtttagcccggccaccggtgtttggggaagtcacattgttttagacagtattcagcaattttcaggcctggagaggactgtcgtgtttgggcttagtccagaatgtgaccagtcagaggaatttcataagctctgctttgcttcaagagccattaaacacctctacctgctttatgaaaagagggcagcctactgaaaattattacaaataatagaggaagacaggaagagcagagtcctttctcctagacaggtagcagtgactccattttaatattacaagtgaggaaatcaaggcacatcagtatgg

SEQ ID NO: 179063 - DNA, 10591 bp, Homo sapiens
  Payload ID: 15294
  Gene Symbol: SLFN5
  Gene Name: schlafen family member 5
  Uniprot ID: Q08AF3
  ENST ID: ENST00000299977
  CDS Start-End: 149-2824
agctgatataagcccgggatcccgccgggtcaggttctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtattttcagacagagtggtatatactccagaaagcctctacaaggaactcttctcacaacataaaggactcagagacttaataaatacagaaatgcgccctttctctcaaggaatattgattttttctcaaagctgggctgtggatttaggtctgcaagagaagcagggagtcatctgtgatgctcttctaatttcccagaacaacacccctattctctacaccatcttcagcaagtgggatgcggggtgcaagggctattctatgatagttgcctattctttgaagcagaagctggtgaacaaaggcggctacactgggaggttatgcatcacccccttggtctgtgtgctgaattctgatagaaaagcacagagcgtttacagttcgtatttacaaatttaccctgaatcctataacttcatgaccccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagcgagaatgtgaaggatggagcaggtagctcatctggccttgtaggtgccgggaacgggcaagacatgttttgaaatgtaagatcacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaagaatttaaaagttttatataaaggcatagctactatctcatctgcccagtgtagtcatgaatagatgtcacataaagaaaagaaaaccagaattcttgttaatatggccagtttgaagggtggtggcggaggtattgagcaggcagctcagggaaatgccagggagacccttgagcacagaaactcctgattgtccccagggactctccgtggacacaggagggattttccaggatttcacatgaattcaatgaagggggctgtgtcttattcctggatgctttgcctccttcatggaattcagtggatttaatggaagttcctaggcaacaataaagagtagaaaccaggttaacagcgagggcctcatctcacaccagatcatatcaggctacacaaaagtagatggaagacaccacccaggcctccagctatacactggagaagaagccaaactagtctacttcatctaagaaagttgtcaaagagagcccttctatactatcttaaggtaaaaagaaagactctacccagctgccctgattaagcattagaaagataagtgttctgatcattaggcgaaagacaatggggaaaaatgtagaaaagaaatatgacatgagccagatgaagaacccatcctgaaaggatatataactcaggggacaaaagacaactcaccataagttgggcgcagtggatcacgcctgtaatctcagcattttggtaggccaaggcaggtggatcacctgaggtcaggagttcaagtccagcctggccaacgtggtgaaatcctgtctctactaaaaatacaaaaattagctgggtgtggtggtgcatgcctgtaataccagctactcagaaggctgaggcaagagaattgcttgaatcaaggaggcagaggttacagtgagccaagatcaggccattgtacttcagcctgggcgacaaagtgagaccctgtctcaaaaaacaaacaaagcctccccatagatgtctcctgccatagaagaatttaagaagttcataaattcaataaaacaagagttgaaggcctgtcccactgtacccaatttctccctctctgaactgcagcctagaaactctctacaggcagtaagctggggcagtcacagaggtgacctcatctgtttcccacatcctgcattaggacagtgatcagggatcagtatccttcattgactgatttccaatatctcgagacctgttgtttcatatattttgccttattttgcaattgtttcatatattttgtcttattttgcaattgtttcaggagggaggataaatatggtccctgttcctctatcttgaccagaagcatctaagaaggcagtgaagcaacatgtgtacagttcttagggaaacaaattttgacctaaaaatattaaacctagtcaaaatattattctagtacaaaggcagcacatgggtatttttgaacataaaagagttctagaaatacaggacccatgaatcattcttgaagaaaagttactcagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggttaaattacagtgagagagttgcacttatttagtttgcataccgtactcaactcttagctagcatagggcaggttccttagttgaaaaatttccacaaaacatgatgtaaagtggaaagatcagttcccccaaagaatatcagttaccaaagtaggatgaaaggatgttgggtagatcaaaacaacaaatgtccattacagcaattaacaaaagttagggagtggggaagtctgagtgctaatatggatttcaaaacaactttaaaaatggcttcaaacattttatgctttttgtaatttagtcattttaatattagataaatcttcctgtaactgaaagttcttgagttaaagaaaaatattcggtagttcagctcttccttcaattttattagttgctttttcttttgttcaagtgaaataaacataaaaataattttaaaatattatgtatcatatccttcgatttaacataattctatctagctgttcttatattttctctgatatatttttaaaagctttctggaatattattaaccttgaatatttctagttgatgagtttatgagtgatttattgcttccttttctctttcagtattgctagaattaattttattgactttgcccctttgcataaagaccttgaaggtcacatgctgaaatcgccctctactaaaacaaactcatagaaataatggggaagatatttcaaaacattgccatatgcatagccatcctcacaaccaagaaaagcgcctctccatgaactaaaacctatgagtcattggtacaggtagggaaaatctaggtaaaccacggtaatacactgaggctggcaccaccacaggccaggacaaccgttgtcacaaagccaggacagaatctcccagccagaaagtgttgccctgaggctgaagccaaattcattttgcccccagttggccagaccaaagcctagaactaaaaaacccatacctcagggtttgtcagcattggcactgctggctttttgggctggacaaccatttattgtgagaggcttctctatgcactgtaggatgtttagcagcatccttggccctactccctagacgccagtagcaaatccaccaccctccctcccctaccccagggttggttgtcagttgtgacaaccaaaaatgtctccagacatcgccaaatgtcccttggggggtaaaatcaccaccaccatacctcttttgactaaaagagtttccagaatagtggcagaatatataggtcaagcataacacattacaatcaagattcagaacatcaaagattcttttttaatcctaaaagaaaaagtttggaaaatctacaaaaagaagtgtgaatttgacaataactatttcactagcaagggtagacgtaagcagaatacaggtagcatattcaaactgctgtggaaaaacaacatcaaacctagacttctctccccaaactatcattcagagtcgagggcaaaataaatagattttctgacttggaacaagtaggaataatgtacttatagtattcatcttcatacagggatggactataagtgatttttaaaaaacttcctacttgttccaagtcagaaaaactattcatatagggatgggctattagcaagagtatatgaataacgtactataacaagaaaaaatgaattgagaagaaagtagtggttttaagaaggaaaggagaacaaataaattagtgaaacataaggttaagtctatacatattattttctaattgcctattatgtcagactacatgtagttagaaaatacgatgaaagaaaaagccatattataattccaacaaaaagataaaataattaagaataactgcaacaagaaaatataagttctgcaacaataaaactatacaatgaaactaaagagcacaaaaaagaacttaaacagataaaaagcagaccacgtttttggataagaagattaaaaattataaatatatcaattttcactgttaatctataaattcagtgtaatcccaataaaaatgccaacaggttttccccaatagcattgaaatgattttaaaatttaatgaaggccaagcatggtggctcactcctgtaatcccagcactttgagaggccgaggcaggtggattgcctgagtccaggagttccagaccagcctggacaacatggtgaaatcccgtctctatttaaaatgcaagaaattagctgggtgtggtggtgtgcacctatagtcctagctactcgggaggctgaggtgggagaatcacccaagccttgggaggtcgaggctgtagtgagccaaaatcacatcactgcactccagtctgggcagccagagtgagaccctgtctcaaaaaaaaaaaaattattggaaactacgaggcaagaatatccaagaaaaatctagaaaagaagaaacctgagtgagtcagcatgaccaaatattaaaacatcttataaagctacaataattaaaacaatgtggtgctgatatgtggagggtcaatggaacaagatgaaatggccaaaaataaatttaaaatacatgttgaaatgtattaacagcatatgttaaagttaagttatgttaactttatatgttaaattcaagttaattggggaaagatggattattcaatatatgatgaacaactctgtcacccagctaaaaaaaattaagcttgggccatatgccagactagataccaaaataaattccaggaggaccaagtttttaaaagtaaaaatatggaatcatggaagtgcatgaagaagaagtagcacttaaaaaaataataatctcagcatggggaaggtctaagtatggccctcaatcagaaaccaggaaggaaaatattgactattttaaacaaaattatctctgtaccaaaaacagcataaaaggtcaagaaacaacacactggaaaaagaattgcaatgaatatcacagccaaatagttaatttcttattttcaaaaaatagcttctacaaatcgaagagaaaaattctaaggtctcaaaggaaaaatgagcaaaggatttgacaggtggtagaatacagaaaaagaatttaaaatagctcctaaagatatggaaacattactcatgatagcagaagtatcaattgacaaaattactcagattggtaacaaactttaagggggaaagcacttccatgcattgctgtaaattggtacatcttctactgagaacaatccggcagtagttaacaaaattgtgaatgcatatatctctttctctagaaatttctcttttgggaatttattctacatatatattcaaacgtgtgaaatacttctatacaggtgattgaatttcactttattcctaagagcagaagactgcaaaatagtaaatatatacccaaaagggtctaatggattagtttttggcatatcagcacatgataatactatgaagccataaaaaagagagatctctatatgtattgatgggggaccatctttaagatatactgtggtgttgaacaaaacaacatgctgaaaatgtctcttattcttttagaatcaatataagtctgtgcttgtaaatgcagtaagtatctttggaagtatacctaaaaattggtaatagtgtttgactccagggaagaacagatgggtgccagagtgaaaaaaagatagcttttgctttttatgacttttggattctgtaccacgtaataattttgatgtaaattttgctgtgtgtgtttttacttgttcatgtagtgattttataaattactcttttaattttctatcaatgaatatcctgggataaacccctcatgatcataatgaataatgatgtgtggagagtggggagggtttacatatgaaaaatgtagaaaatacaaaaagtgtctatatatacaaaaatgtaagtgttaacatttttatatttgcttcaagctttttttttaaataaaagaaatgcaatattgcaattaaa

SEQ ID NO: 179064 - DNA, 2540 bp, Homo sapiens
  Payload ID: 15294
  Gene Symbol: SLFN5
  Gene Name: schlafen family member 5
  ENST ID: ENST00000542451
  CDS Start-End: 114-1283
tctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagc

SEQ ID NO: 179065 - DNA, 1225 bp, Homo sapiens
  Payload ID: 15294
  Gene Symbol: SLFN5
  Gene Name: schlafen family member 5
  Uniprot ID: Q08AF3
  ENST ID: ENST00000592325
  CDS Start-End: 96-1112
gaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccaggttagggagcaatatccacaatggttgtaatgtttgctggcagcaaggcagggcgggtcagagaggaaagagggatatggtattccttggaatctggggaaagagatttactctctga

SEQ ID NO: 179066 - DNA, 1951 bp, Homo sapiens
  Payload ID: 15295
  Gene Symbol: SLFNL1
  Gene Name: schlafen-like 1
  Uniprot ID: Q499Z3
  ENST ID: ENST00000302946
  CDS Start-End: 219-1442
gttccctgagagctaccggccaggggtcgggaggctatgggagctcagggcaggcacctcccatgctcccgcgggagccaccaggacatgaaggtcataggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 179067 - DNA, 4310 bp, Homo sapiens
  Payload ID: 15295
  Gene Symbol: SLFNL1
  Gene Name: schlafen-like 1
  Uniprot ID: Q499Z3
  ENST ID: ENST00000359345
  CDS Start-End: 2578-3801
gaacccaccactccaagctgcctgcagagcacctatactttctaatactattacctaatactagagagccagagacaccgtaaataaccttgttatcttatatttatgtatttaaaagatggttcataaatgtgtttagtgcttaccatgaaagacaatttttacccccatctccaaaaagaagtagaactgattcagctcacagaaggctgttaaaggcgccagagaaatatgtgatgcagtggcttaaagagactgccaggaagagtggggaaagttgctgcactcaagtcaatttgggaaatttcatgcagaacagccacccaatagcaaggcctctaggtaagtagggagaacgcctctggtcatgttcaggtgtttcgtctgtcaaggtgcttctcccggacagctatttctgcacagttcaacacgacttgagttggccatctcaaaacagctatagcctcagttgctgtgagggcacctcatggatgacagaggcaagaaaggcttgagggagagggggtgaggcagggggagcttggagccgtcattctctaaccctaagagctgtggacacaaagccgagcccaacctggctgctgcccgggcgggcaaggagagggcaccgaatgcactctccccagagcctcgcactgccaccagttgaggcctgcgcccctctcttccccgcacaccatagcctcttttcttgagtgctctacccaaactactgcctcaccccctaggaaacaaacatttggtaacatcttcagaaaggctgctttcaaggaaggcagcttctctacgctgtcaaacagctttcttagttgaagcatctaactgtggcaccatccttactgcccccaattggggcttccagaagcagtgtgggcaagcgctgccagccttctgcagaatgatgagcactggtcagtcctgtgctgataaagactgtgtgtcacccacgtcttggtttctccaacagcaggtaacaacctcatcttcccaaagagatagatagctacgcctgacctatttttcagggctcttctggacagcagcctctgtctccagcacagagaagggcctggcgtcagggggagccctggagcctaccatgtgcctcctgctccatcttgggagcagctgggccctgtcagtactcagtagagcctgggattggtgactgactaaagagggaggtggaggctttaggcagcagcgctgaaagaggtggcaagaggtgacctgcatgggaactggggcctgaagagacatcactaagtggggaagtgtgtcccacagccaagctgcatggtgggtgggccgctgggtctgcttccagtgtgtggtgggacccacagggagctgagttttcctgtttgatttcccgcacccagcctgcctgtggctggccaagaaggcattgttgaacctcatgagatcacagaggtagctgtgcaggccccgcccacttcctataaccctggttctggccgtccctgtgccaagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctgtgtcttgctcagtccacgtgactctgctttctcatcctaggcctcaggtgggtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 179068 - DNA, 1865 bp, Homo sapiens
  Payload ID: 15295
  Gene Symbol: SLFNL1
  Gene Name: schlafen-like 1
  Uniprot ID: Q499Z3
  ENST ID: ENST00000372611
  CDS Start-End: 310-1356
tctggccgtccctgtgccaagcctccaagttccctgagagctaccggccaggggtcgggaggctatgggagctcagggcaggcacctcccatgctcccgcgggagccaccaggacatgaagatcccgtcttcccacaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 179069 - DNA, 2654 bp, Homo sapiens
  Payload ID: 15295
  Gene Symbol: SLFNL1
  Gene Name: schlafen-like 1
  Uniprot ID: Q499Z3
  ENST ID: ENST00000372613
  CDS Start-End: 1066-2145
aagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctgtgtcttgctcagtccacgtgactctgctttctcatcctaggcctcaggtgggtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 179070 - DNA, 2117 bp, Homo sapiens
  Payload ID: 15295
  Gene Symbol: SLFNL1
  Gene Name: schlafen-like 1
  Uniprot ID: Q499Z3
  ENST ID: ENST00000439569
  CDS Start-End: 385-1608
aagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctggatcccgtcttcccacaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgg

SEQ ID NO: 179071 - DNA, 1645 bp, Homo sapiens
  Payload ID: 15296
  Gene Symbol: SCHIP1
  Gene Name: schwannomin interacting protein 1
  Uniprot ID: Q9P0W5
  ENST ID: ENST00000445224
  CDS Start-End: 325-1059
ttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcat

SEQ ID NO: 179072 - DNA, 1799 bp, Homo sapiens
  Payload ID: 15296
  Gene Symbol: SCHIP1
  Gene Name: schwannomin interacting protein 1
  ENST ID: ENST00000482804
  CDS Start-End: 442-1224
agattgctagtttcctcacagagctccagtccacactcggccctgaacgcggagttgaatcagctggctgaagctgagtgcctctcttttcctttcttgggaacaggaaaggtgctgtggagaggaattggggcgggatcattcaggggaaggtgacagcagatggtgggaaggccggagtcagcaagccaagtgtcaggggcagagtgagcctcagaaaacagcagctgcccggtgccagagcaaggaaaggccagggaggctgggcggggcagtgtctgtgggacagagtggggcaagaacacacacggccgggcacagcctcttagccagctctccatgtcagtatgagcagtaaccagggaactgggcaattggcacatcagcctatcagaattcatgggaggttatttcttaagtgaaattctaaagagttaaaggatgaatttggacagtgatggaatggatgacatcatcagtcaagaatcctcattggatatggaggggaattataaaaaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaa

SEQ ID NO: 179073 - DNA, 1000 bp, Homo sapiens
  Payload ID: 15296
  Gene Symbol: SCHIP1
  Gene Name: schwannomin interacting protein 1
  ENST ID: ENST00000495954
  CDS Start-End: 246-404
gttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccggcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaac

SEQ ID NO: 179074 - DNA, 2386 bp, Homo sapiens
  Payload ID: 15297
  Gene Symbol: SCEL
  Gene Name: sciellin
  Uniprot ID: O95171
  ENST ID: ENST00000349847
  CDS Start-End: 85-2151
agatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccaga

SEQ ID NO: 179075 - DNA, 3081 bp, Homo sapiens
  Payload ID: 15297
  Gene Symbol: SCEL
  Gene Name: sciellin
  Uniprot ID: O95171
  ENST ID: ENST00000377246
  CDS Start-End: 86-2092
cagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaa

SEQ ID NO: 179076 - DNA, 2269 bp, Homo sapiens
  Payload ID: 15297
  Gene Symbol: SCEL
  Gene Name: sciellin
  ENST ID: ENST00000471491
  CDS Start-End: 121-972
cactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcctcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaagggtaagtcaatctcctaccttgatggagctctttttattcaggttagcttttttacctcattaggaatgggagtgttatgctttcctttgtggcagtgaactcttgtactgctttgacccatcagacctagtaggcaaaaggaatatgttgagtgctgtttcataggacctctgatttgagttacattgaagtaggtgcaggaaaacctgctacataatctcttattccgtattttcttaaataattaagagatgagtcaaattttaatttaaattaagaaatataaaggacaaaattgcacagcgagagccacattgagaagcctttctaaactgatttagacacatttaaatgaaatgctattgtggaaattactaaaggtaagttaaggataattacatcaaagctctttttggtcatttggtcctgaaaacacctgacaccacattcagggacattcttgattatacagatttcagagaaaattgtactgtaacctaactgacaagttttggtgttttttccaaagaagacaaaatctcgaatctgttgctaaagtgaatgccaggatgaataaaacgagcagaaggtgagaactgaacagatgtctctaaatattggttattttctctcatattaattatgtgatattgagggcaccacatctttgtttggcttctctcttctgtgtctaatccctggtgccctgatcttcacttcaaagaatctacagtatattcgatctaaatttacatttacatatagcccaataaaatcctaaggattaattaaactatgttattgattggcaatttttatacttaaagccaatttaatgtcagtataataattttctccaaaagcttgaattaatcattgggaatacagaagatgtatgtgtctaatattatgggaatgttttgaaactgatataaacttttttttttaaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaa

SEQ ID NO: 179077 - DNA, 3096 bp, Homo sapiens
  Payload ID: 15297
  Gene Symbol: SCEL
  Gene Name: sciellin
  Uniprot ID: O95171
  ENST ID: ENST00000535157
  CDS Start-End: 171-2111
aagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagagggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacat

SEQ ID NO: 179078 - DNA, 9713 bp, Homo sapiens
  Payload ID: 15298
  Gene Symbol: SCIN
  Gene Name: scinderin
  Uniprot ID: Q9Y6U3
  ENST ID: ENST00000297029
  CDS Start-End: 102-2249
aacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacacagctctttcatgacaaaatgaattgtattgttatccacttagatacatgtacatgtacagtacatgtttaatatcacaggagatcaaaaagacaatgcacaggggagtatcccagggagcagagccaagttcaagtaagttaacgatatcaagttacttactggcaggtagccactagagaatcttagcaatttttgtcctgcaagatttcagcaaagctacagaaaagtgagtttttatgttttccattcttcccttttctaagtaataatttttatcgcagttaccctgattctattccattccattctattctattctattatttcattctattttatttccaatataccattgtatatcagtatatactgatacactgagtggcagttgcattatctactaatctatataggtcattgaaaaagaagaagctacgttagaacccatggaaagaactttgcctcatgtagagattctagattcttagccaaaagctcagaattgttgggccctaaaggatgaacaatgtagggtccaacaattcatcccacatgaatttttctcatccttcatgtggaatgaaaaaactaaagagacaactgacttaccacacaaatggactatggtagaagctgctgtcccttagtattgaatatctctattttcttttaatcatagaattcactgatattttagcagataatgtggccgtccaggcaggcatgagatttctcagccttacttcaacttgattatgaccatgtgacccaattctgacatttgcctaaaggaaaatttacctaaaaaggcgttttcttgctatggcagtgtaacctgtactaataaatatagtgctagtcctgcatgcaacaaaaatgatgtaagtagacatttaacatttctaggaatgtaattgagtgaaaaataatttttaaaaatatttataaatatcttctgggtcaagctgaatattttttgaaggatgatgagaataaaatgatttaataagtagtactttttcacaaaattagtaaaggtcaaggtgagtggcttagggtacactgtattttacgatgtttctctagtttagccagtggtttttctcatctccaatttatagcacaggccgaggcatatagtagggtctcagttaatatttattgaatggcaatatcaaaaatgagatcagcagcaagatgataaggcagaataaaagttgctgagagcctaaaatgattattcagttctgttgcagggttttaacctgcccaaaggatggaaaaagaagaacataagcataatttctgaatgcatcacggcaaagatgcatgtactcatgaagcataaaattaaaaatatgatacattcactacatgaaaatatgatatacggtttttcttcagtatccgcgggagattggctcgaggaaccccatggataccaacatccttgaatgctcaagtcccttatataaaacggcatagtatttgcataaaacctataccattctcctgtatactctaagtcatctctgcgttacttataatacctaatacagtgtaaacgctgtgtaaacagttgttatactatattggttttttaatttgcattacttttgtattgttgtattattttattgtttttccccaaatagttttgatccgcagatgtagaacccacagatatgataaatcaactgtatctagtacccaaaacagatgagtaacttagaaattaatatgtaatacatacagctaatgttatagctacttaaggaattcctttcactgaaaagaaactcttacaaatcaatgagtcaacaacccaatggaaaaatggccaaaagacatgaatagaagttcacagaaaagaatgaaaatgaccagtaaataatgaaaagatgttctaagacactcttaattaaataaattcacaataaaataatcatacttttatctatctaccagattagcaaatgttaaaatattaaaatgttagtggtcatcaaaatgtagggttacaggttcacccatacactgttaatagatgtataaactggtcaaaactttttgatccatagcacagtattacttttgtaaacatacacaaaaaatattatatatttgccaaacgtatgtactaatctaaaaccaaacacattagactaggtacatgtggagaaagagatacaggtgttccctagcaagttaatatgcttgtgtctcttcaaaccaatatattggcatatttatctaatatttaatcagaagaaagaaagaacagaaagacccaggaagcctactgttagtagaggtcagcctcatcttttctctctgattcaagaaattcatactcaactcagtcaaacagaggtcctgcatttacctcttggtgccggagagccttggtgagccatttagatcctctgtatcttctcaagcacaatcctcagtgttctcttctcgtcttagatagctcatcaaataatatttcccaccacttatttctagcagttctggtaaagagaatggccttcacattgtattttgaacaatgttttggcctccagtaatgattaggaacacactataaacataaaacatcagtccacttaactcattattcagtcatcaagcaattcttgtcccaatcattctccaaagctatatactgtgaatttatactgttgtgtagtgacacaagcccttctgctgaaaaagtaggtagataattactttgaactgaaagaaaacacttattttattttcttttaaacctaatttattttaaacctaatttatttattttaaacctaatttattttaaacctaatttatttattttaaacatttattttaaacctaattcatttgaactgaacttgaatttaaaagcctacaaatgccccgcatatgtagaattatcattcattccgtgttcttgctcttggataaaacggacaactcagagaaaaaactggcttataaatgcacttcacaaaaactgttagaaaagtagccattaaacctgtaaaaaggccgggcgcagtggctgacgcctgtaatcccagcactttgaaaggccaaggcggttggatcacgaggccaggagtccgagaccagcctgaccaacatagtgaaaccccgtctctactaaaaatacaaaaaattagctgggcgtagtggcgggcgcctgtaatcctagctactcgggaggctgaggcaggagaatcgcttgaacccgggaggcggaggttggagcgaaagtacgcgccactgtactccagcctgcgtgacgatgagagtctccgtctcgggggaagaaaaaaaaaacctgtaaaaagtggctcaactttaatattcattaggaaatgactaaaatcaaatattttacttggtaatgccaagtaaaaatacaggagaggatatagtgaaactggagcttacatccactacttgggaagtataaattgatacaatgggtttgaacagtttttgtattttctactaaaatgaacatacacatatcctataatccagaaatcccactccatggtgtgtacccaacaaaaatgcatacatgtgtgtactaaaggatataatatgatttttttttttttttttttttttttgagataggttctcactctgttgcccaggctggagtacagtagcgatctctgctcactgcaatctctgcctcctgggttcaagcaatcctcccacctcagtctccccaggagctgggactctaggtgcgtgccaccacgcccagctaattctttgtagagatggggttttgccatgttgtccaggctggtcttgaactcctagactcaggaaatccacctgccttggcctcccaatatgctgggattacaggcatgagccaccgcatctggacacgaatttttaagttttatatatgtgtgtgtatatatatatatatatatatatatatatatatattttttttttttttttttttttttttgcattggcaaaaaaacaaagatattgtttagcaatttccttgtataatgcaatcagtggaagacaaatcagaggtattattttcccttgggcctttgcagcctgtgttgtttttctctttttcatattgatgtgaaaagcagccaagtattatttgacaacatcagtcccttattaagatgttatttctagtttataattgactatggcatttgcatgcatttcatcatgtctccatttcttcggaatgataatttctaatatacttttcttctattataggaataagaattcagtagtcatatttcctgttgcctataaaaaattgatgctttaatttagttaacatgacaaactccatcttatttagagagattatttttgatgttattataataaaaatgacacctttactaaaaatgtctcatcataaattgttttccattatttctgtgctgattgcaaacaatactgaattaaaatatccctgcaagttcactgtgactcaatctaaggttttaataattcatgaaataaaactaatgttgatgttatccaaatcattctaacgccaacttctaggtaaacagtaaacaagaataagcaaatttgagttttcctaattatttgacattgtcattagcttgtgatccttagatggaatatattttgccagatctcacctcccagggaactgatgagctttaactggaatagtagtgagaatgatagagcagggcccttaactccttagaaaggtcaaaggaagaggtgaatgtgggcagggtttcactggagtattgacacaccaaagatgctatgtaggtgaaaatctctcctaatgcattccctttccaacgaacctgagcctggattcttcagtaacacaatgccttctgagaaacaatgttgttccacattttagagttttggcatgcataatggagtttatggcagagttcagaggatacaatgaaacaagaaagggaggcaactgatgttgtttgattatctccattattttgaaggagccaggtgcttggggaacctggttgtacagaaaggtgatgccaagactctcttgtatgattttcctctctagcttggggctgcaccctctgctgtgggaaggagtcctcaaggtattaatatacatcctatcatttattttagatacagatagcattagagtttatcagtaaagttgggcaactcatggaatattacgagtagaaattgtaattactgtagaatgtatagtgttttgaatggctattgtatttttcagcatacaaattcagaggggtgaaagtaggcaatgacaccactatttatgttttttgttgttgttgtttgtttttgttttgttttgttttgagatggagtcttgcactgtcacccaggctggaggacagtggcatgatctctgctcactgcaacctctgcctcccgtgttcaagcgattctcctgcctcagcctcctgagtagctgggattacaggcacccgccaccacacctgactaattttttgtatttttaagtagagacggagttttgccatgttggccaggctggtcttgaactcctgaacttgtgatccaccctcctctgccttccaaagtgctgggattacaggcatgagccaccgcacccagccctatttatgttttttaaaagcaccatttaccacccatttgtctatggacttaatctatgtctctatgagctggtaaacaatagacaggtaaatacagacttggctgtatttgaacagcaccttcaaaaaccagaagccagaaatcaggtagctagatttgtccatgaaagcaggagattcccttaactggtgatgcctgaagttgggataaagagtcttccaaacatgtgccattttggcatggatatctaaagccaccatgatggctttatattaatgaaggaaataagttgcaggataagtatatccatggtcatccaggggaagaaaatggcgtacataacttatataccatatttaacccagagacagatatcacaggtaaacagtgcaaatcactgtccctagtctgagccatatttagtgtcttgaaagagccacagtggctggctaaaatggcacagtggcaaatcctgaccatggactgccctatgcaaaataactagctccccactttacacagagtacaccatgtcaggcctctgagcccaagctaagccatcatatcccctgtgacctgcacatatacatccagatggcctgaagcaattgaagatctacaaaagaagtgaaaattaccttaactgatgacattccaccattgtgatgtgtttctgccccatcctaactgatcagtgtactttgtaatctcccccacccttaagaaggttctttgtaattcttcccacccttgagaatgtactttgtgagatccaccccctgccagcaaaacattgctcctgactccaccgcctatcccaaaacctataagaactaatgataatcccaccaccctttgctgactctcttttcggactcagcccgcctgcacccaggtgaaataaacagccttgttgctaaccc

SEQ ID NO: 179079 - DNA, 2569 bp, Homo sapiens
  Payload ID: 15298
  Gene Symbol: SCIN
  Gene Name: scinderin
  Uniprot ID: Q9Y6U3
  ENST ID: ENST00000341757
  CDS Start-End: 211-1953
gcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaa

SEQ ID NO: 179080 - DNA, 549 bp, Homo sapiens
  Payload ID: 15298
  Gene Symbol: SCIN
  Gene Name: scinderin
  ENST ID: ENST00000417018
  CDS Start-End: 69-549
ctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggattctacccgcaccatgctgcttgtgggtctggtagacaaaaactccgcttcattcggaagctggcgtcctcagatagaagaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacc

SEQ ID NO: 179081 - DNA, 570 bp, Homo sapiens
  Payload ID: 15298
  Gene Symbol: SCIN
  Gene Name: scinderin
  ENST ID: ENST00000436854
  CDS Start-End: 67-375
gctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggaattggaaaaagcagaaacaaaaacaggccgggcatggtggctcatacctgtaatccccaacaatttaggaggccaaagccagaggactgcttgaggccaggagtttgagaccagcctgggcaacatatggagaccttttccctacaaaacacttttttgagaattagcaaagcatggtggcacgcacctgtagtccaagctgcttgtgagactgaggaaaggagtgttcccaggatgaaagcacagctgctgccatcttcactgttcagatggatgactatttgggtggcaagccagtgcaga

SEQ ID NO: 179082 - DNA, 536 bp, Homo sapiens
  Payload ID: 15298
  Gene Symbol: SCIN
  Gene Name: scinderin
  ENST ID: ENST00000518849
  CDS Start-End: 264-536
tagccaagatggtctcgatctcctgacctcgtgatccgcccgcctcagcctcccaaagatctgggattacaggcgtgagccactgcacccggccagaagctttttcatttattcgtccagcagcatcttgtactagtcctgactgtggcgtgtccccagaaggtcatactccaccatgttgtctcatcttgcacatccccaagaagttgcttctccctgacgtctgcgtttaattaagtgcaataggtgtggaccatcaggaaatggcctccctgatgtctgcattcactttagtgcaacaggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaa

SEQ ID NO: 179083 - DNA, 585 bp, Homo sapiens
  Payload ID: 15298
  Gene Symbol: SCIN
  Gene Name: scinderin
  ENST ID: ENST00000523729
  CDS Start-End: 261-585
cttgctggataggggcgatggttggggggagaggctgggtagtagggactgctgttcctggagctgtcggtattctcggagtagcatcatgtcttgtactgttccatgggtgaaggctctaacacggccctgtaaaaactggtggcgtgtccccagaaggtcatactccaccatgttgtctcatcttgcacatccccaagaagttgcttctccctgacgtctgcgtttaattaagtgcaataggtgtggaccatcaggaaatggcctccctgatgtctgcattcactttagtgcaacaggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcag

SEQ ID NO: 179084 - DNA, 2660 bp, Homo sapiens
  Payload ID: 15298
  Gene Symbol: SCIN
  Gene Name: scinderin
  Uniprot ID: Q9Y6U3
  ENST ID: ENST00000519209
  CDS Start-End: 367-1773
caagatggtctcgatctcctgacctcgtgatccgcccgcctcagcctcccaaagatctgggattacaggcgtgagccactgcacccggccagaagctttttcatttattcgtccagcagcatcttgtactagtcctgactggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 179085 - DNA, 5087 bp, Homo sapiens
  Payload ID: 15299
  Gene Symbol: STIL
  Gene Name: SCL/TAL1 interrupting locus
  ENST ID: ENST00000337817
  CDS Start-End: 365-4090
agttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtgctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaacagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 179086 - DNA, 5225 bp, Homo sapiens
  Payload ID: 15299
  Gene Symbol: STIL
  Gene Name: SCL/TAL1 interrupting locus
  Uniprot ID: Q15468
  ENST ID: ENST00000360380
  CDS Start-End: 365-4228
agttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 179087 - DNA, 5009 bp, Homo sapiens
  Payload ID: 15299
  Gene Symbol: STIL
  Gene Name: SCL/TAL1 interrupting locus
  Uniprot ID: Q15468
  ENST ID: ENST00000371877
  CDS Start-End: 149-4015
gcgaccccaacgtcccagaggcggggccggagtcggcggtggcgctccttggagccggctcccgctcctaccctgcaaacagacctcagctccgcggaagttgcggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaacagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 179088 - DNA, 4558 bp, Homo sapiens
  Payload ID: 15299
  Gene Symbol: STIL
  Gene Name: SCL/TAL1 interrupting locus
  ENST ID: ENST00000396221
  CDS Start-End: 232-4044
gtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaatggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctgg

SEQ ID NO: 179089 - DNA, 633 bp, Homo sapiens
  Payload ID: 15299
  Gene Symbol: STIL
  Gene Name: SCL/TAL1 interrupting locus
  ENST ID: ENST00000436811
  CDS Start-End: 1-633
ccagctttatgatgagaaacacagtccagaagttgaagctggagagccttccttgagaggaataccaaatcagttaaaccaggataaaccagctcttttgagacactgcaaaccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaa

SEQ ID NO: 179090 - DNA, 2984 bp, Homo sapiens
  Payload ID: 15299
  Gene Symbol: STIL
  Gene Name: SCL/TAL1 interrupting locus
  ENST ID: ENST00000447475
  CDS Start-End: 230-2984
agttcccgcgaccccaacgtcccagaggcggggccggagtcggcggtggcgctccttggagccggctcccgctcctaccctgcaaacagacctcagctccgcggaagttgcgcaggagaataatttgatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtgctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaatggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaa

SEQ ID NO: 179091 - DNA, 542 bp, Homo sapiens
  Payload ID: 15299
  Gene Symbol: STIL
  Gene Name: SCL/TAL1 interrupting locus
  ENST ID: ENST00000413565
  CDS Start-End: 266-542
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaag

SEQ ID NO: 179092 - DNA, 999 bp, Homo sapiens
  Payload ID: 15300
  Gene Symbol: SCX
  Gene Name: scleraxis bHLH transcription factor
  Uniprot ID: Q7RTU7
  ENST ID: ENST00000567180
  CDS Start-End: 55-660
ggaggcggcatgagcagcgcgcgacagagctgacgccgcgcccccgccggccccatgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagttaggaggtggccggcagcagccaggaggcagacgctgctgggggaggtggacgcccggggtgactgcagacagcccccaccttggacctgagctgggcaaggcccaccgcaagcatgcccccaggccagccctggctgcgagcggggccgagggacagacggacgtacagacaggcgccggcagcgggactctgcgctggccccagcacctgcccgggcccactggaactttctgcgctggcttttcttccggccactgtgtgatggcatcttgtgtttttgatatgataatataaagtctgaaaattttgtataattaaaaacaaaacagtatcttccaaa

SEQ ID NO: 179093 - DNA, 2300 bp, Homo sapiens
  Payload ID: 15301
  Gene Symbol: SOST
  Gene Name: sclerostin
  Uniprot ID: Q9BQB4
  ENST ID: ENST00000301691
  CDS Start-End: 48-689
agagcctgtgctactggaaggtggcgtgccctcctctggctggtaccatgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggagctggagaacaacaagaccatgaaccgggcggagaacggagggcggcctccccaccacccctttgagaccaaagacgtgtccgagtacagctgccgcgagctgcacttcacccgctacgtgaccgatgggccgtgccgcagcgccaagccggtcaccgagctggtgtgctccggccagtgcggcccggcgcgcctgctgcccaacgccatcggccgcggcaagtggtggcgacctagtgggcccgacttccgctgcatccccgaccgctaccgcgcgcagcgcgtgcagctgctgtgtcccggtggtgaggcgccgcgcgcgcgcaaggtgcgcctggtggcctcgtgcaagtgcaagcgcctcacccgcttccacaaccagtcggagctcaaggacttcgggaccgaggccgctcggccgcagaagggccggaagccgcggccccgcgcccggagcgccaaagccaaccaggccgagctggagaacgcctactagagcccgcccgcgcccctccccaccggcgggcgccccggccctgaacccgcgccccacatttctgtcctctgcgcgtggtttgattgtttatatttcattgtaaatgcctgcaacccagggcagggggctgagaccttccaggccctgaggaatcccgggcgccggcaaggcccccctcagcccgccagctgaggggtcccacggggcaggggagggaattgagagtcacagacactgagccacgcagccccgcctctggggccgcctacctttgctggtcccacttcagaggaggcagaaatggaagcattttcaccgccctggggttttaagggagcggtgtgggagtgggaaagtccagggactggttaagaaagttggataagattcccccttgcacctcgctgcccatcagaaagcctgaggcgtgcccagagcacaagactgggggcaactgtagatgtggtttctagtcctggctctgccactaacttgctgtgtaaccttgaactacacaattctccttcgggacctcaatttccactttgtaaaatgagggtggaggtgggaataggatctcgaggagactattggcatatgattccaaggactccagtgccttttgaatgggcagaggtgagagagagagagagaaagagagagaatgaatgcagttgcattgattcagtgccaaggtcacttccagaattcagagttgtgatgctctcttctgacagccaaagatgaaaaacaaacagaaaaaaaaaagtaaagagtctatttatggctgacatatttacggctgacaaactcctggaagaagctatgctgcttcccagcctggcttccccggatgtttggctacctccacccctccatctcaaagaaataacatcatccattggggtagaaaaggagagggtccgagggtggtgggagggatagaaatcacatccgccccaacttcccaaagagcagcatccctcccccgacccatagccatgttttaaagtcaccttccgaagagaagtgaaaggttcaaggacactggccttgcaggcccgagggagcagccatcacaaactcacagaccagcacatcccttttgagacaccgccttctgcccaccactcacggacacatttctgcctagaaaacagcttcttactgctcttacatgtgatggcatatcttacactaaaagaatattattgggggaaaaactacaagtgctgtacatatgctgagaaactgcagagcataatactgccacccaaaaatctttttgaaaatcatttccagacaacctcttactttctgtgtagtttttaattgttaaaaaaaaaaagttttaaacagaagcacatgacatatgaaagcctgcaggactggtcgtttttttggcaattcttccacgtgggacttgtccacaagaatgaaagtagtggtttttaaagagttaagttacatatttattttctcacttaagttatttatgcaaaagtttttcttgtagagaatgacaatgttaatattgctttatgaattaacagtctgttcttccagagtccagagacattgttaataaagacaatgaatcatgaccgaaag

SEQ ID NO: 179094 - DNA, 1869 bp, Homo sapiens
  Payload ID: 15302
  Gene Symbol: SOSTDC1
  Gene Name: sclerostin domain containing 1
  Uniprot ID: Q6X4U4
  ENST ID: ENST00000307068
  CDS Start-End: 182-802
agggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtatgaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttattgttgttgcctctaacatgtataaagggtgcaaaaattgtagaataaatgtataagggtaa

SEQ ID NO: 179095 - DNA, 2411 bp, Homo sapiens
  Payload ID: 15302
  Gene Symbol: SOSTDC1
  Gene Name: sclerostin domain containing 1
  Uniprot ID: Q6X4U4
  ENST ID: ENST00000396652
  CDS Start-End: 714-1406
aaaatatagagaagtggtctgatggttaattttatatataaatttgactggactaggggatgcccagaagctggtaaaacattatttatgggtgtgtttctgaggatgtttttggaagagattagcattagtattagtggactgagtaaacaagatcaccctcgccaacaggggtggatattatccaatccactgagggccccaatagaacagaaaaacagaggaatgtgaattcatgcttgcttctggagttaggacatccatcttctgccttcagacatcagcattcctagttctcaggtctctgggcttggactaaactacattactggctctctcctgggctccagattgcagacagcagattgtgggacttctcagcctccgtaatcaatcctgtcttggaacctgcttcttagagggcctggactaacatactctggtagtgcatgaagcatctgtgatcacagcgtgacaagaaaatagcacaaacaaacctatgaggacttgagagaattcaaaagggtcatgtagggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacagaacagaaagcttgacgagacaaaattatttctggctatttccaggtgcattcctgaggcagctgcaggaagctcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtatgaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagtta

SEQ ID NO: 179096 - DNA, 4548 bp, Homo sapiens
  Payload ID: 15303
  Gene Symbol: SFMBT1
  Gene Name: Scm-like with four mbt domains 1
  Uniprot ID: Q9UHJ3
  ENST ID: ENST00000394752
  CDS Start-End: 384-2984
ggaatgagtcggagcgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctttccaggtgtctccagtgtagaagcacagcacagaaaacatgttttggagggtaacgcagagcatggagtttctgttagcagtgtcctcagtggcaggataaatactgagatgtggttaaggattctggaaacctctttgcctagccacacttagacttttttcagctaatcctttaaattgaatataatctttagtccgaggattcccatttaaacaactcagtattcttttaagtgtgtcttttagcccagctcaagttaacatgaaactccaggtgaattttcacttactattccattgctagctattatagaataatagcgtttgctgcactattctagtcatgaggagtgaggaaaaacatacataggttgtctcccttaaatggtttgctttgctgaattttttttatcctaatcacctgcaaatttataacccaatcattcttcctcaagatttgaaaatgttttaatcctgcaaactgggtgaattctaaacagctctacaaatataaggaaatattacagcaaa

SEQ ID NO: 179097 - DNA, 850 bp, Homo sapiens
  Payload ID: 15303
  Gene Symbol: SFMBT1
  Gene Name: Scm-like with four mbt domains 1
  ENST ID: ENST00000482396
  CDS Start-End: 487-850
cggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcaggaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaag

SEQ ID NO: 179098 - DNA, 617 bp, Homo sapiens
  Payload ID: 15303
  Gene Symbol: SFMBT1
  Gene Name: Scm-like with four mbt domains 1
  ENST ID: ENST00000483069
  CDS Start-End: 335-617
cgatccccgacgaggggcaggcaaacgggcgcagtgcccgcggcggcggcacgcgcgcatctgggatccggccgcttctccgctcatgccatcttgtccgagccagtcacgtgcgggcgacagcggcgcgcttcgccgggccggtactccaggtccgacccgcgaacccctctgggatccccgccgctctgtctacaacccgagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatt

SEQ ID NO: 179099 - DNA, 699 bp, Homo sapiens
  Payload ID: 15303
  Gene Symbol: SFMBT1
  Gene Name: Scm-like with four mbt domains 1
  ENST ID: ENST00000497586
  CDS Start-End: 549-699
aaacgggcgcagtgcccgcggcggcggcacgcgcgcatctgggatccggccgcttctccgctcatgccatcttgtccgagccagtcacgtgcgggcgacagcggcgcgcttcgccgggccggtactccaggtccgacccgcgaacccctctgggatccccgccgctctgtctacaacccgagaaacgaagtctcactgtgttgtccaggctggtctcaagctcctgggctcaagcaatacttccacctcagcctcccaaaatgctgggattacagatggagtcttgctctgtcgcccaggctggagtgcagtgatgcgatctcggctcactgcaacctccacctcccctggttcaagtgattctcctgcctcagcctcccaagtagctgggactacaagcccgtgccaccatgcccagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttg

SEQ ID NO: 179100 - DNA, 7922 bp, Homo sapiens
  Payload ID: 15304
  Gene Symbol: SFMBT2
  Gene Name: Scm-like with four mbt domains 2
  Uniprot ID: Q5VUG0
  ENST ID: ENST00000361972
  CDS Start-End: 92-2776
cgccttgtgtgtgctggatcctgcgcgggtagatccccgagtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgatgacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacttgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtacaaaaattagaaaaagaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccgcattccttccctggatggtaccgtttcttctccgtctctctttgatgattctttgggaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaattcta

SEQ ID NO: 179101 - DNA, 692 bp, Homo sapiens
  Payload ID: 15304
  Gene Symbol: SFMBT2
  Gene Name: Scm-like with four mbt domains 2
  ENST ID: ENST00000379711
  CDS Start-End: 65-547
aacgcgagctcgggtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgtagagagtgatgtcaagccatcagcttctgttcaacatatttcttagaaaaggatgtctcaaaacttcttcgagaccgtcacgaaatgaaacaactccccgatcccacacgaacctctcccaccaccctcaaacataaaccaacccaaaccctttgaaaagctccaaagaaaataaaatgtttttagaactt

SEQ ID NO: 179102 - DNA, 2402 bp, Homo sapiens
  Payload ID: 15304
  Gene Symbol: SFMBT2
  Gene Name: Scm-like with four mbt domains 2
  ENST ID: ENST00000379713
  CDS Start-End: 194-754
aaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatatagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacatagtttaatctgaaatcttgatggtttatttgaaaataattttatgttgaaacatcttagtatgtatatgtagtatttgtatttgtataatggaacaggaagagaaaggcactgtgtcataagtaattattgaattacctagtctgtttttcttaagaatgcccctaaaaaggggaaaacttaatgaataacaagtaataaggtgtggattttgacagtatcatattctcttaaccttaaactttccctcttttcataaatgatattgacattttagaacgtcatagtctaatatagttaacgggttttgttttgtgaagattttgcctgatgtatttgttatatatcattagagatactattttaattgttcattaacaaatcaaaatgatgatagttcatcctttcaaaaggacaaattgtctcactatgttaattttctaaaacatatttgcctacaaagctggctgaacaaacacccttttcatatgctatcataggctaagaaggtttcttagaaggggcagtaattatacattctgtaaaccaattaccagcttaagtgtagaaataattttacatagtagtctaatttagctgatcattactgtgtgttagacatgtcattgacacacactcatgccttcgtcacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagttt

SEQ ID NO: 179103 - DNA, 8024 bp, Homo sapiens
  Payload ID: 15304
  Gene Symbol: SFMBT2
  Gene Name: Scm-like with four mbt domains 2
  Uniprot ID: Q5VUG0
  ENST ID: ENST00000397167
  CDS Start-End: 194-2878
aaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgatgacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacttgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtacaaaaattagaaaaagaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccgcattccttccctggatggtaccgtttcttctccgtctctctttgatgattctttgggaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaattcta

SEQ ID NO: 179104 - DNA, 9612 bp, Homo sapiens
  Payload ID: 15305
  Gene Symbol: SCO1
  Gene Name: SCO1 cytochrome c oxidase assembly protein
  Uniprot ID: O75880
  ENST ID: ENST00000255390
  CDS Start-End: 62-967
ggaagcggaacgctaccggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcagacaagcgtgatctttttcatgggtgatgagtgggtacatagatggctgcacacagttctcaggaaagagacccacaggctccagcgggcaggtgggtgggacgcttgctgaagtgcagttccccagacccagagctgaattcactgaatctgcagtatgatgcagagacctgcttccatgacagataccccaggtgactcggatgctggcggactgggaccatcccttaagaaagtgttttttggggaaataacttgcctggcacaatggctaatgcctataatcccaaaactttgggaggccagggcctgaggattgctagaggttaggtattcaagacaagcctgggcaacatagtgagaccccccccccccgcccccatctctacagaagatttttttggcatggtggcacatgcctgtagtcctggctactcaggagactgaaatggagtatcacttgagcccaggaattcaaggcttcagtgagctataatcacaccactgcattccagcctgggcaacagagtgagaccctctagatatatctatgtagagatacagaaattaaaatgaatttaaaaataaataaatttgacccttcttttggtgtgtcagccattgaagaaaatgattattgagtgatagaatgaatcttggcttttgtttctaaatttaactgccctagaatcctgggtttggcctttttctgccagaagctgctgccctaggggcaaagttctccaaaagtttttcagtaaatcctaagatgcaacaaatataatgcctagatagacaacagattctttttacatgatatgtttctacacgcacatgatagaggtcttttggtttttaaattctcaatacttaaacctaaatatatcaaagtaaaagtatgtgaaaaaaaactatgctagttataggttgaataatgtcccccaaaatttatacattgaagccctaatctcagtacttcagaatgtgactgtaattggagatagggtctttagagagatagttaaattaaaatgaggctgctaggttggccctaattctatatgactggtgttcttaaaataatagattagctgggcacagtggcttatgcctgtaatcccagcactttgggaggccgaggcgtgcagatcacctaaggtcaggagttcgagaccagcctggccaacatggtgaaacgtcgtctctctcctaaaaatacaaaaattagccgggcatggtagcgggtgcctgtaatctcagttactccggaggctgaggcaggagaatcgcttgaacccaggaggcagaggtggcagtgaggcaagattgcgccatcgtactccagcctgggcgacagagcaagactccgtctcaaaaagaataggagacacagtgagacgaccatgagaagccagagagaaaacagccatcttacaagccaagagagaagttgtgagaaaaaaaaaaaaaaacaaaccctgctgactccttgatttttgccttccaagctccagaactgtgaggaaataaatgtctgttgttttagccaccaaacctggtaaggcagtcctagcaagctaatacaatagcctgttccttaataaacaactgcaagatttagtttatagaaaccagctcggaagcagttggtttagaatgactttcctaggaatctggtcaagaaaggaacttactaaaagactattctcatttaacaaaagagatattaagtatctcaaaggccaaatctttaaaaagattatctgttttaagccacaaaacatttgtgtggatccctttgcagcaagtttgctcttagataagattcagtcttcgttctcagctgttgcaggttaaggcttgtgaaatgatccaaaaagggaacagcagcttttggagaaaacttttatttgttcttcattctagtgtcaagtttaaaggcttgaagtcagaatgttagaagtggggaaggggaccttagaggtgacgtcttccagatgttcctgtttatgcacaaggggacagtctcggagaattaaggcgcaaaactcgggtcccaatttctaggtaggttcctgtttgttctgctgctatcgtgcgcttatggtgactgtgtgaatccaaccaaaacggaggttccgtatgccagtggggcaacgtttttcagctgcaaatcttgggaaatcaaaagcaaggctgttttttttttcttttcttttttgagacagagtttcactcttgttgcccaggctggagtgcaatggcgcaatctcagctcactgcaacctccacctcccaggttcaagcaattctcctgcctcagcctcccaagtagctgggattacaagcatgtgccaccacacccggctaattttgtatttttagtagagactgggtttctctatgttggtcagactggtctcaaactcccgacctcaggtgatccgccgcctcggcctcccaaagtgctgggattacaggtgtgagccaccacgcccggcctcaaggctgtgtttcagtgaaatatcccttgcaaatctttacctgggtgggttacagtgttttcactagactcttcaatagaattaatattttaagaaatgccacttgtttatttgaaaagtataagaatcctatcaatgcagtaggcatgaatgtattcatgtgtctggctgttcatgaagcagctgatatcttaagtgtaagaggtgagatttactgactaccagtaaaatatgcgagttgggaggctaatgattttaaattgtaaatgcgtctgcataagatcctttaaaatagcttttattgttcttaaatttatgtttaaaagaaattgacattaatattttcaaatcatccataatctcccaaaccttttttggttttctgtttagtaccatttaaatctttgtgtatgtgtatatgagctacctttaaaagagcagtcacccatgcgagcatttgttacccaattagtttgtacttttttttggtttttattttgttgttgttatttgtttctttttgagatggagtctcgctcttctcacgcaggctggaatgcaataatggcataatcttggctcactgcaacctccgcctcccaggttcaagcgattctccagcctgagtctcccgagtagctgggattacaggcgcccaccagcacacccagctaaatttttgtatttttagtagagacgggtttctccatgttggtcaggctggtctcgaactctcaacctcaggtgatccgcccgccttggcctcccaaagtgctgggattacacgcgtgagccactgcgcccggcctagtttgtgctttttacttaccagttaggggttatattactgtgtaacaaaatggacggttatttctattcattaacaagattcaagtaatagcctctttagccacatattccttaataacacctttagaccttataggggtaattattttctatatacttttccaatgtatttgaaagtttgttggctcttcttccgtaattatactatatcctcagtaaagaaagtttggcatacagaaaagttgaaggaagaaaattttcaatcactgttgttccactaccaagaaataatacttggaggtatttcctttcaatcttcaacatgaggatgctaatgtccccctcataaggggccttaaagtcactgactctgtgcactatttcatgagaacattgatgtgggtatttaaccgaaagaaaacttgagttttctttttttcctttttattgtgaaaatttggaaacttattcaaaaagtagaatagttaactaattgatgtacccatcagcaagcttcagtgattaccaccatttaattttgtctgcacccccccacccactgccaccccagcccattcccagcatgtgcctctgaaagagaccaactttgtcctttaaaaacaaccacagttggctgggcacggtggctcatgcctgtaatcccagtactttgggaagcaaaggcgggtggatcacctgaggttgagagttcgagactggcctgaccaacatggagaaacccgtctctactaaaaataccaaagttagccgggcgtggtggcgggtgcctgtaatcccagctactcgggaggctgaggtaggagaatcgtgtgaatctgggaggcggaggttgcagtgagccgagatcacgccactgcactccagcctgggcaacaagagttgtctcaaaaaacaaaaaagaaagaaagaaaaaaacaaccacagtttcatcagcacagcaaaaaggtttttgtttttgctcttggattttgtcgtttggtttttgcttaatatcaaatatccagtcagtgtaaactcgtttataatttggtcctttgatttcaaggagctatgatgcagttcgttgtggggatgtgttgtctccatgtcatacatgtgactttgtccatgtttgcacccagttcaaggaagacacaaccctagggaaagacaaccctccccgccaagcctctcttcccattcttaaacatagggtggcgttattcaggttggaccagtttaaaaagactaacgcatttgtcctcgttgttgggtgttttttttctttaaatttgtaaaacaggaataattgtgttaggatgaagtatgatactaggagaacagggaaaactaacccatcgtgttaaaagtcagaatagtgcttaactctggcaggaggtgagatggttagtaattcagaagggggtgccaggagagcttccagagccattgaaatgttcagtagcttgatctgggtgatgatttacatacataaaaacatattaaactttgaacttaagatttatgccttttactgtttgcaccctataactccaaaagaaaagtagaggggaaaaagagtccctgcaaaaggcagtcttgaaagaaagcaagtctgtgatgtggagaatgcattggacagctctcagcaatttgctgtagcttgggcagagagataaaagctaatgccagcatcaggttgcccaggcgagagaaggcctgaaagaagacagcgtggagaaagtgtcagcaagcttcagcaacagcaggaggcagatggtaggagagtgggcctcaggtgtggtgtggcagagcagagtagccacacttaggccccagagacagtgtcttctcaccctcagttgaaggggcaggaaatcaatcgctctagtcacccctaagctggaggacggacctaaagttgccacagctttgagaggcaaagaagtttgctcagtggcttttagagacttctagggccctgggaccctgacactgaggaggagcaaactgaaggggagagtgggcacattccttgttggctgctgtggtgagcagcagctggtcgttgtcagtcaagctccggaccactctgatgatgctcactgcattttgatggagtaagccagggacattaccactgtgtttgagccatctgaagtattcctgggtgggtctgcagttggcagcccgtgatcctttttccattcaaggatgatgcaaaggtaaggggccaaggctgagctctgtagatgcctgtgagagcctcctggtctcaagaggtcataccaagggccttggccaccaaggtttcgtgaggaccttgaggtggtttcgccatcacaatgtcagacgtgtcacacaccatctggtatgtcctcactgtatagaggaagaagggcccaagtggtgaattatctacaagtttgtagcaaagctaatactcagactccctctacagccttgctactcagtgtagtctgtggtccggcagtgtcacaccactggggtacttagcagaaatgcagcttctcaggctccactccagctctcctcaatcacagtctgtttttttgtttgtttgtttgtttgttttgagatggagtttcgctcttgttgcctaggctggagagcagtggtgcgatcttggctcactgcaacctccacctccctggttcaagtgattctgctgcctcagcctcccaagtagctgggattacaggcgcccgccaccatgcccggtggcgtgcatggtaatttttgtatttttagtagaaacaggatctcgccatgttggccaggctggtcttgaactcctgacctcaggtgatccacccgccttggcctcccaaagtactggggattacagatgtgagccaccacgcctggcccacagtctgtattttaacaagatccccacctcagtcttaggcacatggattctcctcaacccccaataccacagagtctattaatttttacccaatagggaaggggaaaaagtcaagaaagaataatgaattaagtaatctttccccctccaggaagctctttatttaatttcgctcccatgaaacacaatttgaagagtctctcaaataaacaaattccattttctgataattatttaattgccccacttttgaaatttttgtcaaagacgactgtcactccctgtcagaacttctattcagcacagtataccaagcgtttctccatcgagttgttataatatgatcaaaaagcagggagagatgctgcttggttaccctgtggggccttatcggggctcagtgcagtctttccatgtaggcattctcaaatactcaattgaaacctgattgaggatcatttgatctctgttggccctagtgcagtaggctgctgagaaccactgatgcaatagactgagagactaactgcctgcttccctgtcagcccaggctctgctaaggccgtcttagttacagaagaaagtggggcagagagccctgcaaggattacattccattcctaacggagacaggcaagcgttcagtgcccgaagcagggcaggcctttgtatggctcacttttccctgtaccagcctcagccccgtacattcagaaagccctgtcgggaacgtgcgggatcacagcacaagacagtcattcactgattgattgacgacgtcaacattgcggaatacctatgttaagctgagtacgagggatataaaaagtaggccctggagagtgcctctgggatgcacataaccagacaagataaagaaaaggcagatcacgagatcaagagatcgagatcatcctggccaacatggtgaaaccccatctctactaaaattacaaaaatcagctagacgtggtggcgggcgcctgtagtcccagctactcaggaggctgaggcaggagaatcgcttgaacccgggaggcagagattgcactgagctgaggtcatgccactgcactccagcctggcaacagggcaagactccatctcaaaaaaaaaaaaaaagaaaaaaaagaaaaattagggcagcttttagacatgaggccccaaagtgccaactagtgcacctaaacttcaactctcttttgagtgttttatgtatctactcagcatccagttgtaaatatgcaaaaatcaatgcctactgtatttaaaaattactaaattcacaataaccacacagaatctataataaatagaatcaatgtaataatgactcagatccaggggaagaaaattataaaattttggaaaaaatgatgagctattaattaagaaaatagtttgttccttggtgagaagactcaatgtaaatatgtcagttttctcctgacttaagtcttcaacacaggcctaataatattgcagtggcaaatgattgccaggggcaggaggggatttggggaagtggtaaaaatgatctgtgtcttggtagtggtcgctgcacaactgcatacatctgtgaaaactcactgaactgcgcactttaaaagggtgaattgtaatatacatacctcaataaaccttacttaaaaatta

SEQ ID NO: 179105 - DNA, 1601 bp, Homo sapiens
  Payload ID: 15305
  Gene Symbol: SCO1
  Gene Name: SCO1 cytochrome c oxidase assembly protein
  ENST ID: ENST00000577427
  CDS Start-End: 24-836
aggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttggatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacata

SEQ ID NO: 179106 - DNA, 571 bp, Homo sapiens
  Payload ID: 15305
  Gene Symbol: SCO1
  Gene Name: SCO1 cytochrome c oxidase assembly protein
  ENST ID: ENST00000577335
  CDS Start-End: 26-301
aaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggtagcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgatt

SEQ ID NO: 179107 - DNA, 992 bp, Homo sapiens
  Payload ID: 15306
  Gene Symbol: SCO2
  Gene Name: SCO2 cytochrome c oxidase assembly protein
  Uniprot ID: O43819
  ENST ID: ENST00000252785
  CDS Start-End: 177-977
tccggggacgcctgcgccctgcctgtgagcgtgtggcgcccgctttccctgagccggcggggcagagcgcagggagctggaggtcggcgcttcctctcgtgcttggtccactgacgcgcggccccgccgcgaggtgcggacgccggggctgggaggggaggaggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgg

SEQ ID NO: 179108 - DNA, 992 bp, Homo sapiens
  Payload ID: 15306
  Gene Symbol: SCO2
  Gene Name: SCO2 cytochrome c oxidase assembly protein
  Uniprot ID: O43819
  ENST ID: ENST00000395693
  CDS Start-End: 149-949
gctccggggacgcctgcgccctgcctgtgagcgtgtggcgcccgctttccctgagccggcggggcagagcgcagggagctggaggtcggcgcttcctctcgtgcttggtccactgacgcgcggccccgccgcgaggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 179109 - DNA, 617 bp, Homo sapiens
  Payload ID: 15306
  Gene Symbol: SCO2
  Gene Name: SCO2 cytochrome c oxidase assembly protein
  ENST ID: ENST00000423348
  CDS Start-End: 208-617
tcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctg

SEQ ID NO: 179110 - DNA, 568 bp, Homo sapiens
  Payload ID: 15306
  Gene Symbol: SCO2
  Gene Name: SCO2 cytochrome c oxidase assembly protein
  ENST ID: ENST00000439934
  CDS Start-End: 159-568
gcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctg

SEQ ID NO: 179111 - DNA, 1002 bp, Homo sapiens
  Payload ID: 15306
  Gene Symbol: SCO2
  Gene Name: SCO2 cytochrome c oxidase assembly protein
  Uniprot ID: O43819
  ENST ID: ENST00000535425
  CDS Start-End: 159-959
gcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 179112 - DNA, 1051 bp, Homo sapiens
  Payload ID: 15306
  Gene Symbol: SCO2
  Gene Name: SCO2 cytochrome c oxidase assembly protein
  Uniprot ID: O43819
  ENST ID: ENST00000543927
  CDS Start-End: 208-1008
tcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggagcatcagatccatgctgctgctgactcggagccccacagcttggcacaggctctctcagctcaagcctcgggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 179113 - DNA, 15589 bp, Homo sapiens
  Payload ID: 15307
  Gene Symbol: SSPO
  Gene Name: SCO-spondin
  ENST ID: ENST00000378016
  CDS Start-End: 1-15453
atgctactccctgccctcctctttgggatggcgtgggccctggctgacgggcggtggtgtgagtggacagagaccatccgtgtggaggaggaagtggcaccccgtcaggaggacctggtaccctgtgccagcctcgaccattacagccgcctgggctggcggctggacctgccctggagtggccgctcggggcttacccggtccccagcgcctgggctctgtcctatctacaaacctccagaaacccggcctgccaagtggaaccggacagtgaggacttgttgcccaggctgggggggcgcccactgcactgaggcccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggagtctgggtgtctggatgcagtggaggtggcccagggctgtgacagccccctggggctcatagacgcagatgtagaacctggccacctgcgggctgaagcccaggacgtgtgccatcagctgctggaaggtccattcgggcagtgccatgcccaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcaggactatgtgaagggacagctactgatcctactggagcatggggcctgcgacgctgggagctgcctgcacgccatctccgtctccctggaggacacccacatccagctcagggactcaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctgcatctgccaggaaaggggcctctggaattgcacggctcgccactgcccttcacaggcattctgccccagggagcttgtctatgcccctggtgcctgtctcctcacctgtgacagccccagcgccaatcactcctgccctgcaggcagtactgatggctgtgtctgtccaccaggcacggtgctgctggacgagcgctgtgtgcctcctgacctctgtccctgccgtcacagtgggcagtggtacctgcccaacgccaccatccaggaagactgcaacgtttgcgtgtgccggggccggcagtggcactgcacaggccagcggcgcagtgggcggtgccaggcatcaggcgccccccactatgtgacatttgacggactggccttcacctatcctggggcctgcgagtatctgctggtgcgagaggccagtggcctattcacagtctctgcccagaacctgccctgtggggccagcggtctcacctgcaccaaagcgctggccgtgcgtctggagggcactgttgtgcacatgctcagaggccgggcagtgacggtgaatggggtgagcgtgacgccccccaaggtctacacaggccctgggctgagcctgcgtcgtgctggcctcttcctgctgctctcgacccacctgggcctcaccctgctctgggatggagggactcgggtcctggtgcaactgtcccctcagttccgtggtcgcgtggctgggctgtgtggtgactttgatggagatgccagtaatgatctgcggagccgccagggcgtcctggagcccacagctgaactggctgcccactcctggcgcctcagccccctctgccctgagccaggagacctgccacacccctgcacgatgaacacacaccgggctggttgggctcgggcccgctgtggggcgctgctgcagccgctcttcacattatgccacgcggaggtccccccgcagcagcactatgagtggtgcctgtatgacgcctgcggctgcgactcggggggtgactgtgagtgcctctgctcggccattgccacctatgcagatgagtgtgcccggcatgggcaccacgtgcgctggcgtagccaggagctctgctccctgcagtgtgaagggggacaggtatatgaggcctgtggccccacgtgtccccccacctgccatgagcagcatcctgagcccgggtggcactgccaggtggtggcctgtgtggagggctgcttctgccccgaggggactctgctgcacggaggagcctgcttggagccagcttcctgcccctgtgagtggggccgcaactccttcccgccggggtctgtgctgcaaaaggactgcgggaactgcacgtgccaggaaggtcaatggcattgtgggggtgacggtggccactgtgaggagcttgtgcctgcctgtgcagagggagaggccctgtgccaagagaatgggcactgtgtgccccatgggtggctttgtgacaaccaggacgactgtggcgatggctctgatgaggagggttgtgccgccccaggctgtggggaggggcagatgacttgcagctccggccactgcctgcccctggccctgctctgtgaccgccaggatgactgtggagatggcacggatgagccgagctatccgtgcccccagggcttgctggcctgtgccgatggacgctgcctgccgccggccctgctctgcgatgggcatcctgactgtctggatgccgccgacgaggagtcctgtctggggcaggtgacctgcgtccccggggaggtgtcctgtgttgatggcacctgcctgggggccatccagctgtgtgacggagtctgggactgcccagatggagccgatgaggggccgggacactgccccctaccttctctgcccacacctcctgccagcaccttgcctggcccctccccaggctccctggacactgcgtcaagtcccctggccagcgccagccctgcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcggggggctgccagccctgggaggccccaacaggacagggcttccctgcccagaatacacctgccccaatggcacctgcataggcttccagctggtgtgtgatgggcagcctgactgtggaaggccagggcaggtgggcccctccccagaagagcagggttgtggggcctggggcccctggagcccatgggggccctgcagccggacgtgtgggccctggggccagggccggagccgccgctgctccccactcggcctcctggtgctacagaactgcccagggcctgagcaccagtctcaggcctgcttcacggcagcctgcccagtggacggtgaatggagcacctggtccccctggtctgtgtgctctgagccgtgcaggggcaccatgacgcggcaacggcagtgccactcaccccagaatgggggccgcacctgtgctgcactgcccggaggcctgcacagcacccgccagaccaagccttgccctcaggacggctgccccaatgccacttgctctggggagctgatgttccagccctgtgccccctgcccactgacctgtgatgacatctctggccaggtcacgtgcccacctgattggccctgcggcagcccgggctgctggtgcccagaagggcaggtgctgggcagcgaggggtggtgtgtgtggccccggcagtgcccctgcctggtggacggtgcccgctactggcctgggcaacgcatcaaggccgactgccagctctgcatctgccaagacggacggccccgacgctgccgactcaacccggactgcgctgtggactgtggctggtcctcctggtcaccctgggccaagtgcctgggcccctgtggaagccagagcatccagtggtccttccggagctccaacaacccccgcccctccggccgaggtcgccagtgccgtggcatccaccgcaaggcacgcaggtgccagacggagccctgtgaggggtgtgagcatcagggccaggtccaccgtgtcggggaacgctggcatgggggcccctgcagggtgtgccagtgtctgcacaacctcaccgcacactgctcaccctactgcccgctcggcagctgcccccagggctgggtcttggtggaggggacgggagaatcatgctgccactgtgccctacctggagagaaccagacggtccagcccatggccactcctgccgcagctccggctcccagtccccagatcagattccctttggccacttacattctgcctccgtcaggagacccctgctattctcccctggggctggccggactggctgaggggagtctgcatgcatcgtcccagcagctggaacaccccacccaggctgccctcctgggggctcccacccaggggcccagccctcagggatggcacgctggaggggatgcttatgccaagtggcacactcggccccattacctgcagctggacctgcttcagcctcggaacctcactggcatcctagtgccggagactggctcctccaacgcatatgccagcagcttctcactccagttcagcagcaatggtctacactggcatgactatcgtgacctcctgcctggcatcttgcccctgcccaagcttttccccagaaactgggatgacctggaccctgccgtatggactttcggccgcatggtgcaggcgaggtttgtcagggtgtggccccacgatgtccaccacagcgatgtccccctgcaggtggagctgctgggctgcgagccagggtccccaccggcacctctgtgcccaggggttggactccgctgtgccagtggtgagtgtgtcctgagagggggcccttgtgacggtgttctggactgcgaggatggctcggatgaggagggctgtgtgttgctgcctgagggcactggcagattccattccacagccaagaccctggccctctcctctgcccagccggggcagctgctgcactggcccagggagggcctggcagagactgagcactggccccctgggcaggaatcccccacgtccccgacagagacaaggcccgtgagtcctggcccagcctccggggtgcctcaccatggggaatctgtgcagatggtgaccaccacccccataccccagatggaggccaggaccctgccaccaggtatggcagctgtgacggtggtgcccccacaccctgtgactccagcgacccctgctggccagagcgtcgccccaggacccttcccacctgtgcagtgtggccccggccagacgccctgtgaggtgctgggctgcgtggaacaggcgcaggtgtgtgatggcagggaggattgcctcgacggctccgacgagaggcactgcgccaggaatctacttatgtggctcccttctctccctgccttgtgggcagcgagcactgtgcccttcatgatgcctaccatggccctgcctgggcttccagcctcaagggccctctgttccccgagccagctgagctgtggcagcggggagtgtctgtctgctgagcggcgctgtgacctgcggcctgactgccaggatggctcggacgaggatggctgtgtggactgcgtgctggccccctggtctgtctggagcagctgcagccgcagctgtggcctgggcctcaccttccagcgccaggagctgctgcggcctcctctgccagggggcagctgcccgcgtgaccggttccgaagccagtcctgctttgtgcaggcctgcccagtggctggggcatgggccatgtgggaggcctggggaccctgcagcgtctcctgcgggggtggccatcagagtcgccagagaagctgtgtggaccccccacccaagaatggcggtgccccctgccccggggcctcccaagagagggcaccctgcggcttgcagccctgctcaggtggcacagactgcgagctgggccgtgtgtatgtgagtgccgatctgtgccagaaggggctggtgcccccatgcccaccctcctgcctggatcccaaggccaacagaagctgcagtgggcattgtgtggaaggatgccgctgtcccccggggctccttctgcatgacactcgctgcctgcccctctctgagtgcccctgcctggtgggcgaagagctgaagtggccaggggtgtccttcctcctgggcaactgcagccaatgcgtgtgtgagaagggggagttgctgtgccaaccagggggctgccccctgccctgcggctggtcagcctggtcctcctgggctccctgcgaccgctcctgtggctctggagtgagggccaggttcaggtctccctccaaccctccggcagcctgggggggtgccccgtgtgaaggtgaccggcaggaactgcagggctgccacacagtgtgtgggacagaggtgttcggctggacgccctggacttcctggtcctcctgctcccaaagctgccttgccccgggagggggccctggctggcgcagtcgttcccgactctgccccagccctggggattcatcctgcccaggagatgccacccaggaggagccctgcagcccccctgtatgcccagtgccaagcatctggggtctgtgggctccctggtccacttgctcagccccctgtgatggaggcatccagacacgtgggcgcagctgctccagcttggctccaggggacaccacgtgcccaggaccccacagtcagaccagggactgcaacacgcagccctgcacagcccagtgcccagagaacatgttgttccgctcagcagagcagtgtcaccaggaggggggtccttgccctcggctatgcctgacgcagggccccgggatagagtgtacgggcttctgcgcccccggctgcacctgcccccctggtcttttcctgcacaatgctagctgcctgccccgcagccagtgcccctgccagctgcacgggcagctctatgcatcaggagcaatggctcgcctggactcctgcaacaactgcacctgtgtctctggtaagatggcatgcacctcggagcgctgcccagtggcctgtggctggagtccctggaccctgtggagtctctgtagctgcagctgcaacgtgggcattcggcgccgcttccgggcaggcactgcacccccagctgcctttgggggtgctgagtgccaaggccccaccatggaggctgaattctgcagcctgcggccatgtccaggtcctggtggggagtggggcccttggtctccgtgctccgtgccctgtggtggtggctacaggaaccgcacccgaggcagcagccgcagcctcatggagttttccacctgtggcctgcagccctgcgcagggccagtgcctggcatgtgtcccagggacaagcagtggctggactgtgcccagggccctgcctcttgtgcagagctcagcgccccaagagggactaaccagacctgccaccctggctgccactgcccctctgggatgcttctgctgaacaacgtgtgtgtgcccacccaggactgcccctgtgcccacgaggggcacctctaccccccgggcagcactgtggttcgtccatgtgaaaactgctcctgtgtctccgggctcatcgccaactgcagctcctggccttgtgcggagggtgagcccacgtggtcaccctggaccccttggagccagtgttcagcctcctgtggccctgcccggtgccatcggcaccggttctgtgccaggtcccccagtgcagtgccatccaccgtggctccgctgcccctgccagccacccccacacctctctgctcaggccccgaggctgaagaggagccatgtctcctgcaggggtgtgatcgagctgggggatggggtccatgggggccctggtcccactgtagccggagctgtgggggaggcctgcggagccggacccgggcctgtgaccagcccccaccccagggcctgggggattactgcgaggggccacgggcacagggggaggtctgccaggctctgccctgcccagtgaccaactgcactgccattgaaggggccgagtatagcccctgtggccctccgtgccctcgctcctgtgatgacctagtgcactgcgtgtggcgctgccagcctggctgctactgcccaccaggccaggtactgagttccaacggggccatctgcgtgcagccgggtcactgcagctgcctggacctgctgaccgggcagcggcaccatccgggtgctcggctggcaaggcctgacggctgcaaccactgcacctgcctggaggggaggctgaactgcacagacctgccctgcccagtgcccggaggctggtgcccgtggtcggagtggacaatgtgctcccagccctgcaggggccagaccaggagccgctccagggcctgtgcctgccccactcctcagcacggtggtgccccgtgcactggagaggctggggaggcaggggcccagcatcagagggaggcctgccccagctacgccacgtgcccagtggacggagcctggggcccatgggggccatggtctccctgcgacatgtgcttggggcagtcccaccggagccgggcgtgcagccggccccccacccctgagggagggaggccctgccctgggaaccacacgcagagtcgcccttgccaggaaaattccacccagtgcacagactgcgggggtggccagagtctgcatccctgtgggcagccctgcccccgctcctgccaggacctgtcccctgggagtgtgtgccagccaggctctgtgggctgccagcccacttgtgggtgccccctgggccagctctcccaggacgggctgtgcgtgcccccagcccactgccgctgccagtaccagcctggagccatggggatccctgagaaccagagccgctcagcagggtctaggtttagctcctgggagagcctggaacccggagaggtggtcactgggccatgtgacaactgcacctgtgtggcaggcattctgcaatgccaggaggtgcctgactgcccggaccctggggtgtggagctcttggggcccttgggaagactgcagtgtttcgtgtgggggcggggagcagctgcgctcccggcgctgtgctcgtcctccctgcccagggcctgcccgccagagccgcacatgcagcacacaggtctgcagagaggcaggctgcccggctggccgcctgtaccgtgaatgccagcccggcgagggatgccccttctcctgcgcccacgtcacgcagcaggtgggctgcttctctgagggctgcgaggagggctgccactgccccgagggcaccttccagcaccgcctggcctgtgtgcaggagtgcccttgtgtgctgacagcctggctgctgcaggagctgggagccaccataggtgaccctggtcagcccctcgggcctggagatgagctggactcaggccagacacttcgtacaagctgtggcaactgctcgtgtgcacacgggaagctgtcttgctccctggacgactgcttcgaggccgatggtggtttcggtccctggagcccgtggggcccgtgctcccgctcctgtggagggctgggcacccgtacccgcagccgccagtgtgtgctcaccatgcccaccctcagtggtcagggctgccgtgggccccgccaggacctcgagtactgccccagcccagactgccctggggctgaagggtccacggtggagccagtaacaggccttccaggtggctggggcccatggtcctcctggtccccctgctccagaagctgcacggaccccgctcgccctgcatggcgcagccgcacccgcctctgcctggctaactgcaccatgggggacccattacaggagcgcccctgcaacctgccctcatgcacagagctgcccgtgtgccctggccctggctgtggggctgggaactgttcctggacctcctgggccccgtgggaaccttgctcccgcagctgcggagtgggccagcagcgccgcctgcgggcataccgtccccctgggcccggcgggcactggtgccccaacatccttactgcctaccaagagcgccgcttctgcaacctgcgagcctgcccagtgcccgggggctggtcacgctggagtccctggtcctggtgtgaccgcagctgtgggggaggccaatccctgagaagccgcagctgctcaagccccccatccaagaacgggggagccccctgtgctggggagcggcaccaggcccgcctctgcaatcccatgccttgtgaggccggctgcccagcaggcatggaggtggtcacctgtgccaaccgctgcccccgccgctgctcagacctccaggagggaattgtgtgtcaggacgaccaggtctgccagaagggctgccgctgcccaaaggggtccctggagcaggatggtggctgcgtgccaattgggcactgtgactgcaccgatgcccagggccacagctgggccccggggagccagcaccaggatgcctgcaacaactgctcatgccaagctgggcagctctcctgcacggctcagccctgcccgcctcccacccactgtgcctggagccactggtcggcctggagtccctgcagccactcatgcgggcccagagggcagcagagccgcttccggtcctccacgtcgggctcgtgggccccagagtgtcgggaggagcagtcccagagccagccctgccctcagccctcgtgcccacccctgtgcctgcagggcactcgctcccgcaccctgggggacagctggctgcagggggagtgccagcggtgctcctgcaccccggagggtgtgatctgcgaagatacggagtgtgcagtgcctgaggcttggacgctgtggtcctcctggtccgactgccctgtctcctgtggaggtggaaaccaggtccgaacccgggcctgcagggccgcagcccctcaccacaggagcccaccctgcctgggccctgacacccagaccaggcagcagccttgcccagggctgctggaggcctgctcctggggcccgtgggggccctgttcccgcagctgcggcccgggcctggcctctcgctctgggtcctgcccctgcctgatggccaaggccgaccccacctgcaacagcaccttcctccacctggacacccagggctgctactcagggccctgcccagaggagtgtgtgtggagcagctggagcagctggacgcgctgctcttgccgggtgctggtgcagcagcgctaccgacaccagggcccggcgtcccgaggggccagggcaggcgccccctgcacgcggctggatggccacttccggccttgccttatcagcaactgctctgaggacagctgcacgcctccctttgagttccatgcctgcggctccccctgtgctgggctctgtgccacacacctgagccatcagctctgccaggacctgccaccctgccagccgggctgctactgccccaaggggctgctggagcaggctgggggctgcattcccccagaggagtgtaactgctggcatacctcagcagcaggagccgggatgaccctggcccctggggaccgcctgcagctgggctgtaaggagtgtgaatgccggcgtggggagctgcactgcaccagccagggctgtcaaggtcttctgcctctgagtgagtggtccgagtggtcgccctgtgggccctgcctgccgcccagcgccctggcccctgcctccaggactgccctagaggagcactggctccgagacccaactggcctctcccccaccttggccccgctgctggcttcagagcagcaccgccaccggctctgtctggatcctgcgacagggaggccctggactggagcccctcacctctgcaccgcacccctcagccagcagcgcctctgccctgaccctggagcctgccctgactcatgccagtggagtctgtgggggccatggagcccctgccaggtgccctgcagtggggggttcaggctacgctggagagaggcagaggccctctgtggaggaggctgccgggagccatgggctcaagaaagctgcaacggagggccctgcccagagagctgcgaggcccaagacactgtattcaccctggactgtgccaaccagtgcccacacagctgtgccgacctctgggaccgcgttcagtgtctgcagggaccctgccgcccaggctgccgctgtccccctggccagctggtccaggatgggcgctgtgtgccgatctcctcttgccgctgtggcctccccagtgccaatgcctcttgggagctggccccggcccaggcggtgcagctggactgccaaaactgcacctgtgtcaacgagtccctggtgtgcccacaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagctgctgcacaatggcacgtgtgtgcctcccactgcctgcccctgcacccagcattctctgccctggggcctcaccctgaccctggaagagcaggcccaggagctgcccccagggactgtgctcacccggaactgcacccgctgtgtctgccacggtggagccttcagctgctccctcgttgactgtcaggtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctgcctggatctgaatggcaggaggcctgtgagagctgcctctgcctcagtgggaggcctgtctgcacccagcactgctccccactcacctgtgctcagggcgaggagatggtgctggagccagggagctgctgtccctcttgccgcagggaggctccggaggagcagtcgccctcctgccagctcctcacggagcttcgaaacttcaccaaagggacctgttacctggaccaggtagaagtgagctactgcagtgggtactgcccatccagcacccatgtcatgccagaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccagggtggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaa

SEQ ID NO: 179114 - DNA, 667 bp, Homo sapiens
  Payload ID: 15308
  Gene Symbol: SCP2D1
  Gene Name: SCP2 sterol-binding domain containing 1
  Uniprot ID: Q9UJQ7
  ENST ID: ENST00000377428
  CDS Start-End: 91-561
ctttgatgtcacaatctgacctgtgggtattaatctggtcacagctgctcacagactagatggcaaggtccaggggactagcacaggaagatgtggaagagaagtgaccatcaacccaagatcaaagcagaggatggacctctggtgggccagttcgaggttctgggttcagttccagaacctgccatgccacatcctctagagctgtcagaatttgagagcttcccagtgtttcaggacattaggcttcacatcagggaagtgggagctcaattggtcaagaaagtcaatgccgtctttcagctggacatcaccaaaaatgggaagaccattttgcggtggaccattgatctgaagaatggttctggggacatgtatccgggacctgccaggctcccagcagacactgtctttacaatcccggagtctgtctttatggagctggttttgggcaaaatgaacccgcagaaggctttccttgccggaaagttcaaagtgagtggcaaggttctgcttagctggaagctggaaagggttttcaaagactgggctaaattttaagcatgcaaaaataccaaggaagaacttctcttcgatgataatgtcgagtggaaatcatgcttaatctgaagattaaagtaaaaagtatccaatatttttactcaaa

SEQ ID NO: 179115 - DNA, 3779 bp, Homo sapiens
  Payload ID: 15309
  Gene Symbol: SCRT1
  Gene Name: scratch family zinc finger 1
  Uniprot ID: Q9BWW7
  ENST ID: ENST00000569446
  CDS Start-End: 113-1159
gtggggacccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggcgctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccttcaagcaatagggtcccgaggggagacccaccccgagccccctcccctcccctccagggtgcccccggctttctcccagcaatagggtcgacgagacctagaaccgaacctcatctccgagttgggtctctgaagacgggggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccaccccccacccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgcccctgagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcagactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgggggctgcggccgccggcccgcccgcccccacccccgcctgtgccccgccgccttgtacatattcccacccggaataggccgggatttttactcgggccgtgcccctcttccgcccccatttggggccaggccggccggacagacggacggacggacagacctccttcctaagcacaatagcaccagctccccggagcaccgcacctccacaaggagaataaatgccactcttgatagaa

SEQ ID NO: 179116 - DNA, 3577 bp, Homo sapiens
  Payload ID: 15310
  Gene Symbol: SCRT2
  Gene Name: scratch family zinc finger 2
  Uniprot ID: Q9NQ03
  ENST ID: ENST00000246104
  CDS Start-End: 579-1502
ctttcttctctctctgtttctctcttgtgtctttttgtccttatcttggtctctctgcttctatttctacctctctcagcgtgtgcgtctctctttccctgtatgtctctgtctttctccgagtctctcttcttctccccgcccccctcactcccctttctccgtccctctctgtctctgcgcctttctcgccctcactttctcccctcctgcctgctccgggcctgcccccaccgccgccggttcaggggaacgtgtgcggagcgattgtcctgggggacatttgatggattagagcgccgagcggttccattgctaggggaccacctgatctccagcctgcgtcccatataaagccggcagccggagtgctgagcgcagctcccgcgatcccctgtctgcgcgccgccgccgccaagcccgagcccgagccggggccgccgccaccggtgccggctccgagcggcctcccgcgctccagcccgctgggagctgtccagtgctgaaaacccgcgcggacacagccgatcgcgcccggccggccgcctccccgcaccgagccccgcgccggccgcgccatgccgcgctccttcctggtaaagaagatcaaaggggacggcttccagtgcagcggggtgccggcccccacctaccaccccttggagacagcctacgtgctgcctggcgcccgggggcctcccggggacaacgggtacgccccgcaccgcctgcccccgagcagctacgatgcggaccagaagccgggcctggagctggccccggccgagcccgcgtacccgccggcggcgccggaggagtacagcgaccccgaaagcccgcagtcgagcctgtcggcgcgctacttccgaggggaggcggcagtgaccgacagctactccatggacgccttcttcatctcggacgggcgctcgcggcggcggcggggcgggggcggcggggacgcggggggctcgggagacgcggggggcgccggggggcgcgcggggcgcgcgggggcgcaggcgggcggcgggcaccggcacgcgtgcgccgagtgcggcaagacctacgccacgtcgtcgaacctgagccgccacaagcagacgcaccgcagcctggacagccagctggcgcgcaaatgcccgacgtgcggcaaggcctacgtgtccatgcccgcgctcgccatgcacctgctcacgcacaacctgcgccacaagtgcggcgtctgcggcaaggccttctcgcggccctggctgctgcagggtcacatgcgctcgcacaccggcgaaaagccgttcggctgcgcgcactgcggcaaggccttcgccgaccgctccaacctgcgcgcgcacatgcagacgcactcggccttcaagcactaccgctgccgccagtgcgacaagagcttcgcgctcaagtcctacctccacaagcactgcgaggcggcctgcgccaaggcggccgagccacccccgccgacccccgccggcccggccagctgagccttccgcctcgccctcgcgcccggaactcgctctccacgcgccccgggccccctacctgcgcccgcagcgccctcgcccagccccggctgcgtttccctgcccatgaccctctcgtggggacccccggcccggcccggaacttttctccccaacccccaaacccacgactcacttccacaccgtcttccccagcgtcccccgacccacttcatcctttccggccatccctcggaccttgacccccctgtccgcgccttcaaggctcccaactcaggcaccaggtccgcacctctcccgcgccccagagccggaaatttctccctcccagaccccgcgctgctcttctaacttctagatcttttctctcgcttctcagctgaatctctctgaccattcctctactggagcccccaatgaaagccgcaaacctatacccttgacgcccatacctgcctcagtttccccatccacacctggacgcaggccctgccgccctgagaccacagtccaaccccagaccatccctctggcctctgctgaatctcccagagtgtgtccatctggggatctaatcttcacccttcttgaagtctccgatctgtccctgatcccatccatgctcaggccttaggtctggccattcacacacacacacacccccacaccccactcccacacacagttcctactgtcttcagtccatggggatctcatcacccactcccagccccagctccagctgccctcacctctctagcagctctcacccctctgagtctacctaacctggagggggcttgaggggcacttcagggccctgccccctaatgtaacccctctctcaccccggcacaacctgggcttccacagtctggagctgccctacccccagattctctgagcactttcccccatccccagggccacagatccccttccttacttgttggggggaggtctggagcacctcgccaatgcccttcccccatccggctgggtccttccagttatttatttgtgtatttatttatttatctatttattattctatttaatctcttggcctcacccagggaccgtctggcttccccagctggactgggaggtcaggaagccaggcaaggagagggacagcacaggccacagagggctgcccccaccacacacacccccgcgtctcgggagaaacccaccctcttcagagcctgcactcgctaaggaaggggactcgagaatgggggggcagcttgctgaccctcaactgggggggtgagggagcatcaggaggtccaggcgtggggcaggtccccaccttcctgaaccttcccctgccactccaggcggcccggagagaggagcctcttcgatttgtttcctgtttattcttcttcccgagggaccccaggttccagggaccgactgagccccggacccgctggggcctctggcctgctccccgggaggggcgctctctcccggccatgtctatgcaactctcccggacagaggggccgggctgccagccacccgcccgttggccgccactacctcctccgctgcgcttttgcatgcccgggcgaggaccgaagcacacacctccacgcgcacgggccctggccccctccgctttaagcacacgcctctgccccattgctctgcagccagcttgggggcaggagtcctggactctcagatcctcctctcccctcctcttagccacaaaagaggggggagactggaggcacccctgcagcaggggcacttccctagggctccagaggggtgaatgggcctttgctcagctccaggcccagcgggaagggaggctgcagggatggtgggagggagaggggtagcagaagcaattatggaggcgttgaccctgtaaatagcaacttctgacagcaataattttccatgcatgctaagccttttggccatattttgtatgagcgcttggcgctcctcctccgtcctatcccaactcacccccaaacccccatcccttccccacctccagcagtattacttgtaacgcaattcagggatattaaagggactttggccactca

SEQ ID NO: 179117 - DNA, 5143 bp, Homo sapiens
  Payload ID: 15311
  Gene Symbol: SCRIB
  Gene Name: scribbled planar cell polarity protein
  Uniprot ID: Q14160
  ENST ID: ENST00000320476
  CDS Start-End: 8-4900
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcc

SEQ ID NO: 179118 - DNA, 5218 bp, Homo sapiens
  Payload ID: 15311
  Gene Symbol: SCRIB
  Gene Name: scribbled planar cell polarity protein
  Uniprot ID: Q14160
  ENST ID: ENST00000356994
  CDS Start-End: 8-4975
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgcccttgtctggaaagaagtttgactacagggcctttgcggccctgccttcttccagacctgtctatgacatccagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcc

SEQ ID NO: 179119 - DNA, 5108 bp, Homo sapiens
  Payload ID: 15311
  Gene Symbol: SCRIB
  Gene Name: scribbled planar cell polarity protein
  Uniprot ID: Q14160
  ENST ID: ENST00000377533
  CDS Start-End: 222-4871
gagtgaaacccgtggggattcagggaggtggatggggttagggtggaacttggattcaggtggctgatgagtactagcttcttgggccgctctggaggtgggtccagacctcctctccttttttgctgggtgcagggccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgaccgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttt

SEQ ID NO: 179120 - DNA, 2189 bp, Homo sapiens
  Payload ID: 15311
  Gene Symbol: SCRIB
  Gene Name: scribbled planar cell polarity protein
  ENST ID: ENST00000526832
  CDS Start-End: 1-1951
ccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggctttgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaaggtgaggggcacggaagtggggtgggggttgggtctcggctggtctggcctgacccaccctgccctccggcagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccacccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 179121 - DNA, 421 bp, Homo sapiens
  Payload ID: 15311
  Gene Symbol: SCRIB
  Gene Name: scribbled planar cell polarity protein
  ENST ID: ENST00000531942
  CDS Start-End: 1-421
gaagaggaagaggccagcactgaggaggaggacaaggagggggccgtggtttctgcgccctctgtcaagctgaccctcactatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggc

SEQ ID NO: 179122 - DNA, 5108 bp, Homo sapiens; identical to SEQ ID NO: 179119
  Payload ID: 15311
  Gene Symbol: SCRIB
  Gene Name: scribbled planar cell polarity protein
  ENST ID: ENST00000611528
  CDS Start-End: 222-4871

SEQ ID NO: 179123 - DNA, 5143 bp, Homo sapiens; identical to SEQ ID NO: 179117
  Payload ID: 15311
  Gene Symbol: SCRIB
  Gene Name: scribbled planar cell polarity protein
  ENST ID: ENST00000622455
  CDS Start-End: 8-4900

SEQ ID NO: 179124 - DNA, 5218 bp, Homo sapiens; identical to SEQ ID NO: 179118
  Payload ID: 15311
  Gene Symbol: SCRIB
  Gene Name: scribbled planar cell polarity protein
  ENST ID: ENST00000612204
  CDS Start-End: 8-4975

SEQ ID NO: 179125 - DNA, 2189 bp, Homo sapiens; identical to SEQ ID NO: 179120
  Payload ID: 15311
  Gene Symbol: SCRIB
  Gene Name: scribbled planar cell polarity protein
  ENST ID: ENST00000634208
  CDS Start-End: 1-1951

SEQ ID NO: 179126 - DNA, 421 bp, Homo sapiens; identical to SEQ ID NO: 179121
  Payload ID: 15311
  Gene Symbol: SCRIB
  Gene Name: scribbled planar cell polarity protein
  ENST ID: ENST00000633098
  CDS Start-End: 1-421

SEQ ID NO: 179127 - DNA, 2642 bp, Homo sapiens
  Payload ID: 15312
  Gene Symbol: SCYL1
  Gene Name: SCY1-like, kinase-like 1
  Uniprot ID: Q96KG9
  ENST ID: ENST00000270176
  CDS Start-End: 78-2504
ctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179128 - DNA, 1659 bp, Homo sapiens
  Payload ID: 15312
  Gene Symbol: SCYL1
  Gene Name: SCY1-like, kinase-like 1
  ENST ID: ENST00000279270
  CDS Start-End: 210-1022
cagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctcctacactcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttc

SEQ ID NO: 179129 - DNA, 2583 bp, Homo sapiens
  Payload ID: 15312
  Gene Symbol: SCYL1
  Gene Name: SCY1-like, kinase-like 1
  Uniprot ID: Q96KG9
  ENST ID: ENST00000420247
  CDS Start-End: 70-2445
cccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179130 - DNA, 2584 bp, Homo sapiens
  Payload ID: 15312
  Gene Symbol: SCYL1
  Gene Name: SCY1-like, kinase-like 1
  ENST ID: ENST00000525364
  CDS Start-End: 78-2420
ctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179131 - DNA, 896 bp, Homo sapiens
  Payload ID: 15312
  Gene Symbol: SCYL1
  Gene Name: SCY1-like, kinase-like 1
  ENST ID: ENST00000531601
  CDS Start-End: 1-526
ccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtgggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtcc

SEQ ID NO: 179132 - DNA, 2715 bp, Homo sapiens
  Payload ID: 15312
  Gene Symbol: SCYL1
  Gene Name: SCY1-like, kinase-like 1
  ENST ID: ENST00000524944
  CDS Start-End: 34-2361
aaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179133 - DNA, 981 bp, Homo sapiens
  Payload ID: 15312
  Gene Symbol: SCYL1
  Gene Name: SCY1-like, kinase-like 1
  ENST ID: ENST00000528545
  CDS Start-End: 1-843
aaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179134 - DNA, 2586 bp, Homo sapiens
  Payload ID: 15312
  Gene Symbol: SCYL1
  Gene Name: SCY1-like, kinase-like 1
  ENST ID: ENST00000527009
  CDS Start-End: 480-2477
ggcggagggaccgagggaccgacaggcggacagggccggggtcacgtgggcccggcgaagtgtccctaaggctgacctggggagagacctggctgcgggcccttgtcttccggccacacaacagctctgggaccatctcaggccccgctgccctcccctaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacata

SEQ ID NO: 179135 - DNA, 2570 bp, Homo sapiens
  Payload ID: 15312
  Gene Symbol: SCYL1
  Gene Name: SCY1-like, kinase-like 1
  Uniprot ID: Q96KG9
  ENST ID: ENST00000533862
  CDS Start-End: 43-2406
cccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 179136 - DNA, 5779 bp, Homo sapiens
  Payload ID: 15313
  Gene Symbol: SCYL2
  Gene Name: SCY1-like, kinase-like 2
  Uniprot ID: Q6P3W7
  ENST ID: ENST00000360820
  CDS Start-End: 438-3227
gaagaaggaagaggtaagtgaccggccgccggcaccgaccgacctccctcaccggcggctctctcgcctgggctcccggagccggcgaggagggaatggaggactcgcgcccgggttaggcctcccagggccgctcaggctggtgggtgttgcctggtgacgggcctgccggcggccggccgggcgatcggcggtcggcgcccgcgcaaagcggggctggacgagcagcgagctccggggagcggatccgagagggccgagtcctcgaaagaggccttgaggcgacgggagacccgggatcgaagtcagctgccggagggagagccccccatgccggctcgagagctcgggtttcggtggtggagaacgtagtacctttcggggacattggacactactctaggaccgggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttccata

SEQ ID NO: 179137 - DNA, 2328 bp, Homo sapiens
  Payload ID: 15313
  Gene Symbol: SCYL2
  Gene Name: SCY1-like, kinase-like 2
  ENST ID: ENST00000549687
  CDS Start-End: 286-2328
aggaagtgacgtcatgcccccggccggcaggtcttttagtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaa

SEQ ID NO: 179138 - DNA, 429 bp, Homo sapiens
  Payload ID: 15313
  Gene Symbol: SCYL2
  Gene Name: SCY1-like, kinase-like 2
  ENST ID: ENST00000548871
  CDS Start-End: 1-182
caagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggaaactgaggctcagagaggtaaaataagtgattcaagatcatataagtggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataat

SEQ ID NO: 179139 - DNA, 501 bp, Homo sapiens
  Payload ID: 15313
  Gene Symbol: SCYL2
  Gene Name: SCY1-like, kinase-like 2
  ENST ID: ENST00000550251
  CDS Start-End: 1-345
cgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccagatttgccttcttaaaggtgagggtatgctgcctttgtccaaatgacatggatgagtggggaaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgc

SEQ ID NO: 179140 - DNA, 790 bp, Homo sapiens
  Payload ID: 15313
  Gene Symbol: SCYL2
  Gene Name: SCY1-like, kinase-like 2
  ENST ID: ENST00000548392
  CDS Start-End: 563-790
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatg

SEQ ID NO: 179141 - DNA, 3948 bp, Homo sapiens
  Payload ID: 15313
  Gene Symbol: SCYL2
  Gene Name: SCY1-like, kinase-like 2
  ENST ID: ENST00000635101
  CDS Start-End: 180-2981
gacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccaggctagcaacatgattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaa

SEQ ID NO: 179142 - DNA, 2916 bp, Homo sapiens
  Payload ID: 15314
  Gene Symbol: SCYL3
  Gene Name: SCY1-like, kinase-like 3
  Uniprot ID: Q8IZE3
  ENST ID: ENST00000367770
  CDS Start-End: 49-2277
ctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaagattctcctatgtgtgtcgtctgcagccatcacagtcagatctcgccaatcttggagaaccccttctctagcatattccctaaatgtttcttttctggcagcacgcccatcaacagcaagaagcacatacagcgagattactacaatactcttttacagacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 179143 - DNA, 6364 bp, Homo sapiens
  Payload ID: 15314
  Gene Symbol: SCYL3
  Gene Name: SCY1-like, kinase-like 3
  Uniprot ID: Q8IZE3
  ENST ID: ENST00000367771
  CDS Start-End: 216-2282
tttccggacccgtctctatggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaatttgttttatatctgttagaaaatgtacagacataagtattttcagttgacaaagcatcaaacccagttctgcctagtgataagtttcaccctagagtatgtatgtaacgttttagcttatccatcctttcttggagcgcctccatttccattgaaagccaggctggagcaggacccttttggagtagtgactcagttgcttccaaagcccctgctattgtatgcagcgctgacctgtactcttcttcccaggggaactcctgacgagctctttttgcataaggctggaaaaaaaacataagtaatatcacaatatccattctaaatataaagaaccttccttttggactggagtaaagcttacatgcaaattttattctagtcattggatcacaagggtaggaggatgcaccccaaaacccctacacagtcatctagaaaaatatgtaaaggcattttggtttatcatagcaattcagagtgctactaccagtgtcttagtttgtatgtggtatacaacaagtatcctgtcccaaagggctcccaatgagaagtgctgcatagtccaagcttacatgtcttataaacaagttcataaatgtattttctttttatgagagtttgactaaaacttatcagaatgttgttcttcatgaattactactatactaattactatactaatagtgctcaaaacaatattttgaatatccttattggtgtcaaattctgccttttaataagtagatgtgatcttcagttactgccaaaaattattaggagactcatttgattaataaggcaaggaatcaaactaaacatttaggagtaagtttctttcattttcttctgtggttcagtaaagactgcatttatagcatcactggtacaatatgtaacttcccttaaaggttactaccaataattcaaacatactgaaagaatatatttgatatggtgtagtcccacttcttaattttaaaagcaactaccataaaacagaattttacatgtctagatctatttgatttgaaattcagcataaggctggaaaccacactggtttgtttcgtcagtaagtaaaaagggcagaatttgccttgttaaagtttggcccctattgaaatcagcccatacctgtaaagatgacctctttgcttcttctacagtcacattagcaaagggttcccagaaaatacctttttcctgtttcacacgttccactttggcagcttcagtttcatctacaaacccagtctgccagggaccatgaaaaaccaagcaaatagcaacatgttagcactctactagatatgaaatggccacataatttaagtgctgagtgttcaaccatactaggcaaattctggaagtcacatggactgatctataaatactcttagtataatctggattaaatcactctactgtgttcttccttacaaaatagttagttatagagttgtctttgcaggaaaaaatgatagtctgctaacctttactgtataagctaagaaactggcaacagcagtgtatacacatgtacttaaaatccagcttagatgtaatataagtaggccaagtgtggtggctcatgcctctaatcccaggactttggtgggaggaatgcttgagcccaggagtttgaggttatagcgagctatgatcacaccaccacactccaatctgggcgacagagcgagactctgtctaaaaaataaagttcagtgagtcaagtgggcccatttcacctaaaaaaatatatatgtaatatatgtaaaatatataacgtgcatcattacatgtaatatatcaaataattcagtttctcctggtagtctaaatttgtggtttaacagttccactagtatttcaattaactattatttcctcacactaagttcccaagtatgcatagacataggaaccttgtgattcaaaattttggttttaattgtaaaaacaggtcttggctgcaaagagaataaaaaagccatgccaaaaaaaaaaaaaaaaaaaaaaaaaaaagggccctgagcttaccctggcttgggaggctgcccaaataaaaaaaaaaaaaaaaaaaaaaaaaagccatgcctaaattatacccaaaatatggtagtaaacatcctctcaggcctacctaattatgtgatcaagtgtatttaattatgattattaatagcttagggatcctcattagtcatctcactgcctggataatcagtgctattacaccccaaactacaggcagaggaactacaagtgtccttttttgagacagtctcactctgtcgctcaggctggagtgcagtggcatgatcttggcttactgcaatctctacctccccagttcaagcaattctcctgcctcagcctcccgagtagctgggactgcaggcgcgtaccaccatgcccggctaatttttgtatttttagtagaaacagggtttccccatgttggccaggctggtcttgaactcctgacctcatgatccacccaccttggcctcccaaagtgctgggattacaggcatgagccgccgcgcctggccccaagtgttttacttctgtggcctcaattgcttagtaaaagtcgtcagcactgtgctcagcactgtgaaaagtttaagctaagaagacactcaggttggttacagttacataatttcggaaaaaaaaaaataggacaaagaataaaacatgagccatgtaaagaaagtaccttctccagaaaggatacaactttgttcttagtttcttcagaactgagacactgtggaactatctcttcatgatttgttccctattaaaaaattgatgaacaagaccaattttaacatttcaacaacttgcaaagacaaatagatgagttttatgagctaccttaaccaaaaattcattttaagtaagagtcccagaggatcctcaaaggtgataaactcatgattccttcagggtccctaaggataatacaaaattaacttctgtacaagtgttgtaagctttaattacttctgctgggtcatactaatgcttctggactcccttatgatcataggcatgactatacagcaaatgcagtaagagtaaaggagcaacccatcttacaggtttaggttcatcagcctaacccttatgactgatagcacaaaatgaaatgtattatcatttgacccaaaaatactatctgctggaagactgtgtctgtgtctgtctgtatcagtaggcctgctgtgtatgcctgttctggtccttgtttattcagaggaccttacgaaattcacttcatttatctaagcctcattttgagaagctgtaaaagagataacgagtaatgtacccttcagacaattttccgattgcaatacagaagcagttcaataaatgttttgggattgttctggaatatttgaaatattaaaatggtttgaaagtca

SEQ ID NO: 179144 - DNA, 3090 bp, Homo sapiens
  Payload ID: 15314
  Gene Symbol: SCYL3
  Gene Name: SCY1-like, kinase-like 3
  Uniprot ID: Q8IZE3
  ENST ID: ENST00000367772
  CDS Start-End: 223-2451
tgtcccgtttccggacccgtctctatggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaagattctcctatgtgtgtcgtctgcagccatcacagtcagatctcgccaatcttggagaaccccttctctagcatattccctaaatgtttcttttctggcagcacgcccatcaacagcaagaagcacatacagcgagattactacaatactcttttacagacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 179145 - DNA, 2077 bp, Homo sapiens
  Payload ID: 15314
  Gene Symbol: SCYL3
  Gene Name: SCY1-like, kinase-like 3
  ENST ID: ENST00000423670
  CDS Start-End: 312-2077
gcacctctactgtttgctacaagtggccagcagccattttggatttgggcggaaatgaaattaaaactgtgctgttaaaagcctaaaaattcaagtcaagacaaacttaagcattcgaccaacacatctagaaagggggcatcttcgtggactaactagaccactggggcagtgagtgaaactcggtatcgtcgcggcgcccacacttaagatggcaccggcctgagactcagctgtgcggcctctctacctcggttcctgatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcaca

SEQ ID NO: 179146 - DNA, 3017 bp, Homo sapiens
  Payload ID: 15315
  Gene Symbol: SDAD1
  Gene Name: SDA1 domain containing 1
  Uniprot ID: Q9NVU7
  ENST ID: ENST00000356260
  CDS Start-End: 120-2183
gcgctatttccggtcatacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaat

SEQ ID NO: 179147 - DNA, 3080 bp, Homo sapiens
  Payload ID: 15315
  Gene Symbol: SDAD1
  Gene Name: SDA1 domain containing 1
  ENST ID: ENST00000395710
  CDS Start-End: 98-316
gaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagaacatcctaaatgtatgcatctgaattataggagagaaagagagcaacttcagaagagcctttgctttgttacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaatacgtaccttt

SEQ ID NO: 179148 - DNA, 2513 bp, Homo sapiens
  Payload ID: 15315
  Gene Symbol: SDAD1
  Gene Name: SDA1 domain containing 1
  ENST ID: ENST00000395711
  CDS Start-End: 97-2049
aaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataaga

SEQ ID NO: 179149 - DNA, 802 bp, Homo sapiens
  Payload ID: 15315
  Gene Symbol: SDAD1
  Gene Name: SDA1 domain containing 1
  ENST ID: ENST00000503411
  CDS Start-End: 91-357
gagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacaggagagaaagagagcaacttcagaagagcctttgctttgttacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgg

SEQ ID NO: 179150 - DNA, 563 bp, Homo sapiens
  Payload ID: 15315
  Gene Symbol: SDAD1
  Gene Name: SDA1 domain containing 1
  ENST ID: ENST00000514710
  CDS Start-End: 236-379
atacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggaggtgggagtgcggcgcggcagacgctagaggccggatagtggatggttgagacgccgtttctacagcagtataatcactacaaatccaatgtggagattttcaaattgcaaccaaataaacccagcaaagaactagcagagctggtgatgtttatggcacagaacatcctaaatgtatgcatctgaattataggagagaaagagagcaacttcagaagagcctttgctttgttacagattagtcactgctacccagagtacctaagtaattttcctcaagaggtgaaagatcttctctcctgcaatcataccgtattggatccagatctgcgaatgacattttgcaaagctttgatcttgctgagaaata

SEQ ID NO: 179151 - DNA, 3975 bp, Homo sapiens
  Payload ID: 15316
  Gene Symbol: SDE2
  Gene Name: SDE2 telomere maintenance homolog (S. pombe)
  Uniprot ID: Q6IQ49
  ENST ID: ENST00000272091
  CDS Start-End: 20-1375
ggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgggtaggggtttatcagttttactgatctgactttttattttattttattttttttgagacagtcttacactgtctcccaggctggagtgcagtggcgcgatctcggcttactgcaagctctgccttccgggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctgatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatgcgtattttaggccaggtgtggtggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacata

SEQ ID NO: 179152 - DNA, 4897 bp, Homo sapiens
  Payload ID: 15317
  Gene Symbol: SUDS3
  Gene Name: SDS3 homolog, SIN3A corepressor complex component
  Uniprot ID: Q9H7L9
  ENST ID: ENST00000543473
  CDS Start-End: 313-1299
ggattttaagacggcgatgaaagggctgaggttgtggcgacgggggcgtccagcggcatctccactcccccaaggatggcggaatcaggccgttgtcgggcagctctcgacccggaagtcgctcgcggcgcgaggcccccgttgccgagcgcgggcgcggggggcggagctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgag

SEQ ID NO: 179153 - DNA, 665 bp, Homo sapiens
  Payload ID: 15318
  Gene Symbol: SEBOX
  Gene Name: SEBOX homeobox
  Uniprot ID: Q9HB31
  ENST ID: ENST00000438614
  CDS Start-End: 15-665
atgataaaacccaaatgggggggtctggtgtgggcacagcctggcatggccctctggcacggccctctggcaccttaccctttgccagctccatgcccagccctgtggatgcatcctcagcagacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 179154 - DNA, 666 bp, Homo sapiens
  Payload ID: 15318
  Gene Symbol: SEBOX
  Gene Name: SEBOX homeobox
  ENST ID: ENST00000536498
  CDS Start-End: 94-666
atgataaaacccaaatgggggggtctggtgtgggcacagccctggcatggccctctggcacggccctctggcaccttaccctttgccagctccatgcccagccctgtggatgcatcctcagcagacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcgtcaatgtggaccactcctag

SEQ ID NO: 179155 - DNA, 2016 bp, Homo sapiens
  Payload ID: 15319
  Gene Symbol: SCFD1
  Gene Name: sec1 family domain containing 1
  ENST ID: ENST00000311943
  CDS Start-End: 13-504
gtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaagccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattg

SEQ ID NO: 179156 - DNA, 2021 bp, Homo sapiens
  Payload ID: 15319
  Gene Symbol: SCFD1
  Gene Name: sec1 family domain containing 1
  Uniprot ID: Q8WVM8
  ENST ID: ENST00000396629
  CDS Start-End: 187-1839
agccaagatggcggcggcggcggcagcgacagcagcagcagcagccagtattcgggaaaggcagacaggtactgacttattctcttctccttgaagcttcgtgactgccccgacgacatccttctcctctggcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcag

SEQ ID NO: 179157 - DNA, 2359 bp, Homo sapiens
  Payload ID: 15319
  Gene Symbol: SCFD1
  Gene Name: sec1 family domain containing 1
  Uniprot ID: Q8WVM8
  ENST ID: ENST00000458591
  CDS Start-End: 228-2156
aggataaaaactcttagtattcgcctaacattacgggccactgaattaacctgcaccgggtctcccagttctaccgagagtggaggtcttcctggaggaggtggggtccggaactcaggcacaccctttggccccgcccttccgggctttgcttccggggcggtaagggcagccacgtcatccccccgctccgctccccagccgggcagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgtt

SEQ ID NO: 179158 - DNA, 2058 bp, Homo sapiens
  Payload ID: 15319
  Gene Symbol: SCFD1
  Gene Name: sec1 family domain containing 1
  Uniprot ID: Q8WVM8
  ENST ID: ENST00000544052
  CDS Start-End: 151-1878
agtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttc

SEQ ID NO: 179159 - DNA, 688 bp, Homo sapiens
  Payload ID: 15319
  Gene Symbol: SCFD1
  Gene Name: sec1 family domain containing 1
  ENST ID: ENST00000554437
  CDS Start-End: 1-108
gcttttaccaagatggcctcagctccggccagctatggcagcactaccactaaaccaatgggctgtgatacccatggcagcagaaattctcaagacccttctgtttagtgaaaacaaaggtgtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaa

SEQ ID NO: 179160 - DNA, 743 bp, Homo sapiens
  Payload ID: 15319
  Gene Symbol: SCFD1
  Gene Name: sec1 family domain containing 1
  ENST ID: ENST00000557076
  CDS Start-End: 150-743
tgggagccaagatggcggcggcggcggcagcgacagcagcagcagcagccagtattcgggaaaggcagacaggtactgacttattctcttctccttgaagcttcgtgactgccccgacgacatccttctcctctgtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtg

SEQ ID NO: 179161 - DNA, 556 bp, Homo sapiens
  Payload ID: 15319
  Gene Symbol: SCFD1
  Gene Name: sec1 family domain containing 1
  ENST ID: ENST00000557713
  CDS Start-End: 158-436
gtggctcgtgggagccaagatggcggcggcggcggcagcgacagcagcagcagcagccagtattcgggaaaggcagacaggtactgacttattctcttctccttgaagcttcgtgactgccccgacgacatccttctcctctgtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggtagaatcagttacaagggtggctgcaaaagtcaatatttagatgagtcaccccaaagaaaatctagcaagattcttttagcaaggaaaaggagaaaagtagatattggataggatcttcgaaatcaactatatgaatcatattatttaaattttatttctg

SEQ ID NO: 179162 - DNA, 1943 bp, Homo sapiens
  Payload ID: 15319
  Gene Symbol: SCFD1
  Gene Name: sec1 family domain containing 1
  ENST ID: ENST00000463622
  CDS Start-End: 21-167
agtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttcc

SEQ ID NO: 179163 - DNA, 1829 bp, Homo sapiens
  Payload ID: 15319
  Gene Symbol: SCFD1
  Gene Name: sec1 family domain containing 1
  ENST ID: ENST00000556768
  CDS Start-End: 21-248
agtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcag

SEQ ID NO: 179164 - DNA, 583 bp, Homo sapiens
  Payload ID: 15319
  Gene Symbol: SCFD1
  Gene Name: sec1 family domain containing 1
  ENST ID: ENST00000554776
  CDS Start-End: 1-308
tggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccagccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactg

SEQ ID NO: 179165 - DNA, 2308 bp, Homo sapiens
  Payload ID: 15319
  Gene Symbol: SCFD1
  Gene Name: sec1 family domain containing 1
  ENST ID: ENST00000484733
  CDS Start-End: 151-318
agtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggcatcaaatctatgttcacatcaacaagaagagggacatggactgtgccagccctgactgttgattttgatcaggaatttaagcctttccagaaactcccagaagacctttatttatttctcactaggtagaatcagttacaagggtggctgcaaaagtcaatatttagatgagtcaccccaaagaaaatctagcaagattcttttagcaaggaaaaggagaaaagtagatattggataggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaa

SEQ ID NO: 179166 - DNA, 490 bp, Homo sapiens
  Payload ID: 15319
  Gene Symbol: SCFD1
  Gene Name: sec1 family domain containing 1
  ENST ID: ENST00000553693
  CDS Start-End: 237-490
gggagccaagatggcggcggcggcggcagcgacagcagcagcagcagccagtattcgggaaaggcagacaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtga

SEQ ID NO: 179167 - DNA, 1553 bp, Homo sapiens
  Payload ID: 15319
  Gene Symbol: SCFD1
  Gene Name: sec1 family domain containing 1
  ENST ID: ENST00000555259
  CDS Start-End: 29-394
agccgggcagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtttgggggatacatgtgcaagtttgttacatgggtaaattgcgtgtcactggggtttggtgtacaaatgaattcgtcacccaggccatgggcatggtacctgatagggagttttttgaccctcatcctctatgctcaggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggaatctacctgttactcgtattttggacaatcttatggagatgaagtc

SEQ ID NO: 179168 - DNA, 696 bp, Homo sapiens
  Payload ID: 15319
  Gene Symbol: SCFD1
  Gene Name: sec1 family domain containing 1
  ENST ID: ENST00000469043
  CDS Start-End: 1-435
gtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggagaggtggatttgattgttcagctgcagagctgtggacttcagtcaaagggatggacattattttatctctgtttttttacttggcctttattttttcaaatcttaggttctctttttgtacctttcaccctctgctactgactcttattatttgaaacattaaatcggaagttatactaatagacatagggactttaattaaagtttacctttttttccagtcaagaataaaaaaaaaatggtttccaaataaatatgtattttttaaaaggtt

SEQ ID NO: 179169 - DNA, 2221 bp, Homo sapiens
  Payload ID: 15320
  Gene Symbol: SCFD2
  Gene Name: sec1 family domain containing 2
  Uniprot ID: Q8WU76
  ENST ID: ENST00000388940
  CDS Start-End: 121-2040
agaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattctt

SEQ ID NO: 179170 - DNA, 3176 bp, Homo sapiens
  Payload ID: 15320
  Gene Symbol: SCFD2
  Gene Name: sec1 family domain containing 2
  Uniprot ID: Q8WU76
  ENST ID: ENST00000401642
  CDS Start-End: 135-2189
tcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctgtttgtgatcttcctgattccacctacaagttcattagttctaaataaaagcctgttggcaagtgttggtagattacaactctttttatttgaagttgctcgagaagttagacatgctttagaattatgagtgtggggaaaatttgatgttccttaggattatataactgaggagggaacattgcaaatagggtctgaggctttgtttctctcttgctctgaaacatttctgaaaaggcaaggaagggaggggtagtgtctggggcagtgctggtagcctgcatgtgttgtaaatcatcctgccataacaaaggactgcattgttctagctggcccactgggcaggtctgccaggctacttggaactgtagtgggaaggtggttgattggagggttatctgtatataaaaggttttctcccctccaaagaaagactccagtacaagatacctggtcccagggagtctaaattgtaacagcaacccctgtggactttgtgggtatgagttttgattgaaatataaagctttcttttctgtaagtttaagttttccatctgaccatagcagaaaaacctagacccacctagtgaaactttgtaagaactccagggcaaaaacgaaccacttgcaacccacatgtttgtaggtgtatggtcgatggaagtttctggcatccatgttggtaataaagagataaaactgaaaa

SEQ ID NO: 179171 - DNA, 529 bp, Homo sapiens
  Payload ID: 15320
  Gene Symbol: SCFD2
  Gene Name: sec1 family domain containing 2
  ENST ID: ENST00000503450
  CDS Start-End: 444-529
gtgtcagaggccgaccacgtgtactgtggagactgtcaaagtctcccggagcccaatttccggaagcggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccag

SEQ ID NO: 179172 - DNA, 1320 bp, Homo sapiens
  Payload ID: 15320
  Gene Symbol: SCFD2
  Gene Name: sec1 family domain containing 2
  ENST ID: ENST00000611795
  CDS Start-End: 1-1320
atgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattgga

SEQ ID NO: 179173 - DNA, 1656 bp, Homo sapiens
  Payload ID: 15321
  Gene Symbol: SEC11A
  Gene Name: SEC11 homolog A, signal peptidase complex subunit
  Uniprot ID: P67812
  ENST ID: ENST00000268220
  CDS Start-End: 642-1181
agaaagagacagacagacagaaagtaagcaagcaagcaagcaagcacctcaacagagacagagacgtaaagaaagagagacagagacagaaagaaagaaagcacctcctcagcttcccatagcgcaggagacttgctcgaccagagaacctacggtcagacgacacatccactgccacacccatacccaagccgggacgcggaaccgcttctacccgcccacaccggagaggttgctcgcgattggccgggcgggcacagaggcccgccttccgaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaa

SEQ ID NO: 179174 - DNA, 1223 bp, Homo sapiens
  Payload ID: 15321
  Gene Symbol: SEC11A
  Gene Name: SEC11 homolog A, signal peptidase complex subunit
  Uniprot ID: P67812
  ENST ID: ENST00000455959
  CDS Start-End: 303-764
cagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtacaatgagagaaatgcaaagatagttaagaaagactcggccttcaaggagcctaaatgtgtagaaaaggactaaggcaaaacaataacttttttgagctcttgccatgtgtgaagcactttatacacctgtaagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaa

SEQ ID NO: 179175 - DNA, 1089 bp, Homo sapiens
  Payload ID: 15321
  Gene Symbol: SEC11A
  Gene Name: SEC11 homolog A, signal peptidase complex subunit
  Uniprot ID: P67812
  ENST ID: ENST00000560266
  CDS Start-End: 37-531
ctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggattttatcaggagaacagttcagtggaggacaggaattatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaa

SEQ ID NO: 179176 - DNA, 971 bp, Homo sapiens
  Payload ID: 15321
  Gene Symbol: SEC11A
  Gene Name: SEC11 homolog A, signal peptidase complex subunit
  Uniprot ID: P67812
  ENST ID: ENST00000558134
  CDS Start-End: 15-572
tcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaa

SEQ ID NO: 179177 - DNA, 1256 bp, Homo sapiens
  Payload ID: 15321
  Gene Symbol: SEC11A
  Gene Name: SEC11 homolog A, signal peptidase complex subunit
  ENST ID: ENST00000559729
  CDS Start-End: 386-775
acagaggcccgccttccgaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcaggcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaacccctt

SEQ ID NO: 179178 - DNA, 882 bp, Homo sapiens
  Payload ID: 15321
  Gene Symbol: SEC11A
  Gene Name: SEC11 homolog A, signal peptidase complex subunit
  ENST ID: ENST00000558217
  CDS Start-End: 1-408
gactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaaatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattga

SEQ ID NO: 179179 - DNA, 819 bp, Homo sapiens
  Payload ID: 15321
  Gene Symbol: SEC11A
  Gene Name: SEC11 homolog A, signal peptidase complex subunit
  ENST ID: ENST00000560409
  CDS Start-End: 53-544
cgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccagggggtcatcagtgcttctgagaaatactagtccccatcttcctcagttcccaagatgctgctaatatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcg

SEQ ID NO: 179180 - DNA, 540 bp, Homo sapiens
  Payload ID: 15321
  Gene Symbol: SEC11A
  Gene Name: SEC11 homolog A, signal peptidase complex subunit
  ENST ID: ENST00000558196
  CDS Start-End: 222-540
tctagactttttggacgatgtgcggcggatgaacaagcggcaggagacagaggttgcagtgagctgagatggcaccactgtactccagcctgggtgactgagcaagagcgaggctccatctcaaaaaaaaaaaaaaaaagaaaaagaaaaagtaatagaggagttcagaagcagagacagattactcttggctgctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggc

SEQ ID NO: 179181 - DNA, 727 bp, Homo sapiens
  Payload ID: 15322
  Gene Symbol: SEC11C
  Gene Name: SEC11 homolog C, signal peptidase complex subunit
  ENST ID: ENST00000299714
  CDS Start-End: 75-374
ggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctgagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 179182 - DNA, 718 bp, Homo sapiens
  Payload ID: 15322
  Gene Symbol: SEC11C
  Gene Name: SEC11 homolog C, signal peptidase complex subunit
  ENST ID: ENST00000588875
  CDS Start-End: 51-536
gtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagaggtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 179183 - DNA, 1202 bp, Homo sapiens
  Payload ID: 15322
  Gene Symbol: SEC11C
  Gene Name: SEC11 homolog C, signal peptidase complex subunit
  Uniprot ID: Q9BY50
  ENST ID: ENST00000587834
  CDS Start-End: 473-1051
ctttcctcgctgcagtcatccaatagccaagatacacggctaggtgatttgcgagcgggagttaggtgtcctcttggcgcctgaccagagtcgggaaattcagctcctcttgagtagtcccttccccgagttgccccccgaggtatgcggggtcactcgctgctcgatgttccctccgaagggtcggacaaggctccggagccctgtagctgccctccctaggagccccgggtcttcactggccgaggtgcccaccccgcagcattctgggagtggtagttttcttccttcaggttcattcctggctggccagtgcccaagactggcgagactacgattcccagacgcccaagcgagtcgccggtcacgtggccgcaaggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaagatg

SEQ ID NO: 179184 - DNA, 2054 bp, Homo sapiens
  Payload ID: 15322
  Gene Symbol: SEC11C
  Gene Name: SEC11 homolog C, signal peptidase complex subunit
  ENST ID: ENST00000509791
  CDS Start-End: 84-554
cggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtgaggattcacctttaagttatatagaaggttatgaaaaacacttagaaatgaagaaattaaatcaataggctaatgagtcgttaattacaaatatgacatatcaggagagttttaagcagttctagtttatcctgtgaagactaaatacaacttagaaattcctaaagacctaaaatctaaaactgaacccaattatattatctatatgatgggttcaaatctgtttcaaaataaatccagccaggcgcagtggctcacacctgtaatcccagcacctttgggaggctgaggcaggaggatcacttgagcccaggagttccagaccagcctgagtaacatagggataccccatctctattaataaaaattttaaaaaatttgttctaaaaaaagaagaaatataaatcctcactgagagattagttatttgtggattttaaataaccattacaagaaagtctcccagagataaccactgtttaacatttcagggaatgctgtaggtactctctgggctggtacagatgtgtgttatgcatatatataattttacttagaatttgattatttttcacccaacaggaagttggaaatagcttttcgtgtcaaatctacatctgtatctttttaagtggctacaagctgttttattgcgaataattatttatttaaccaatccccttttggtggacacttagattatttcctgtttttcgcaactaaaaacatttctgtgatacatcttttagtattcatctttgtatagttgtccagcaatgagttctgcttctgattgacataacagagaatgtatcctcattaaaaaccaaacaagggaattcttcccctctcttggcaaccctttttatgtttaacagccattagaaatgtttttttatcttacctaaatctcactagctttttaaggctggagagactggctcccattttgtcaggtttagcgttattagtcagattgtggcttacagcttcttcctcctcctttaaccatttttctttgttgcattttcacttgaacatctccggggggaccaggagggcttccagttagtccatcctgtctttccagacactctggtgaaaggctttggataagagagaggatggaactactgatttataaaagactggagggtacctatgggtgtgttaccttgtttcccatgagcagagatgattgagacctgggtccatctgattacatattgctgttgattttgtgagcataatcgttggctggtttatgcactgaacctccttgctctgggatcataatcatatttgagtataagttatggtattcacatttgtatttgctacccaatacatttatttgttatatctgacaagcactgggaaatgaaaataattatttgcattacaaactcattattcatgtactttgaaagctttatctaacagcagtttttatatgggctatctgaatcttatcttctaaataaaaactagatttgtgaaa

SEQ ID NO: 179185 - DNA, 1425 bp, Homo sapiens
  Payload ID: 15323
  Gene Symbol: SEC13
  Gene Name: SEC13 homolog, nuclear pore and COPII coat complex component
  Uniprot ID: P55735
  ENST ID: ENST00000350697
  CDS Start-End: 127-1095
ccgagcgcgttgctgcccggaggctcctacgccacggcccgtcgggcccggcgccggaagtgagctgttccgaggcgccgccgggagctgccacgtccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 179186 - DNA, 1363 bp, Homo sapiens
  Payload ID: 15323
  Gene Symbol: SEC13
  Gene Name: SEC13 homolog, nuclear pore and COPII coat complex component
  ENST ID: ENST00000337354
  CDS Start-End: 56-1033
ccgagacctggagcagccaccgccgcaatcatgggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 179187 - DNA, 1479 bp, Homo sapiens
  Payload ID: 15323
  Gene Symbol: SEC13
  Gene Name: SEC13 homolog, nuclear pore and COPII coat complex component
  Uniprot ID: P55735
  ENST ID: ENST00000383801
  CDS Start-End: 73-1179
gtccgagacctggagcagccaccgccgcaatcatgacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaa

SEQ ID NO: 179188 - DNA, 1467 bp, Homo sapiens
  Payload ID: 15323
  Gene Symbol: SEC13
  Gene Name: SEC13 homolog, nuclear pore and COPII coat complex component
  Uniprot ID: P55735
  ENST ID: ENST00000397109
  CDS Start-End: 211-1137
tggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 179189 - DNA, 1603 bp, Homo sapiens
  Payload ID: 15323
  Gene Symbol: SEC13
  Gene Name: SEC13 homolog, nuclear pore and COPII coat complex component
  ENST ID: ENST00000397117
  CDS Start-End: 593-1447
gccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaat

SEQ ID NO: 179190 - DNA, 669 bp, Homo sapiens
  Payload ID: 15323
  Gene Symbol: SEC13
  Gene Name: SEC13 homolog, nuclear pore and COPII coat complex component
  ENST ID: ENST00000445064
  CDS Start-End: 588-669
gcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccagacttcggggacctggtttttagagagtctagaatctgatgagagaacctgtgcttacttgggcttgtgctggaaaagatgaaatggggaaaatggtgtcagtaattaacactgtggata

SEQ ID NO: 179191 - DNA, 567 bp, Homo sapiens
  Payload ID: 15323
  Gene Symbol: SEC13
  Gene Name: SEC13 homolog, nuclear pore and COPII coat complex component
  ENST ID: ENST00000428626
  CDS Start-End: 484-567
aatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtgacttcggggacctggtttttagagagtctagaatctgatgagagaacctgtgcttacttgggcttgtgctggaaaagatgaaatggggaaaatggtgtcagtaattaacactgtggatacc

SEQ ID NO: 179192 - DNA, 832 bp, Homo sapiens
  Payload ID: 15323
  Gene Symbol: SEC13
  Gene Name: SEC13 homolog, nuclear pore and COPII coat complex component
  ENST ID: ENST00000431352
  CDS Start-End: 575-832
ccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtc

SEQ ID NO: 179193 - DNA, 594 bp, Homo sapiens
  Payload ID: 15323
  Gene Symbol: SEC13
  Gene Name: SEC13 homolog, nuclear pore and COPII coat complex component
  ENST ID: ENST00000432213
  CDS Start-End: 521-594
agctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtgacttcggggacctggtttttagagagtctagaatctgatgagagaacctgtgcttacttggtgtgtacctcttgaactgctttgcagccatcctcttccactgtctgcctt

SEQ ID NO: 179194 - DNA, 1675 bp, Homo sapiens
  Payload ID: 15324
  Gene Symbol: SESTD1
  Gene Name: SEC14 and spectrin domains 1
  ENST ID: ENST00000335289
  CDS Start-End: 1-320
ttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataa

SEQ ID NO: 179195 - DNA, 460 bp, Homo sapiens
  Payload ID: 15324
  Gene Symbol: SESTD1
  Gene Name: SEC14 and spectrin domains 1
  ENST ID: ENST00000452991
  CDS Start-End: 153-434
gggcccgctccgcccccagcccgccttcctcccgccgcgccctccgcctccgcccgcacctcgctagcgttcccctgtcttccccaacgccccggagccgccggccgctagcgtcagcgccagccagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagatgagctgtttgggacttgctgtttgaactggactttgatcagtggcagtttt

SEQ ID NO: 179196 - DNA, 724 bp, Homo sapiens
  Payload ID: 15324
  Gene Symbol: SESTD1
  Gene Name: SEC14 and spectrin domains 1
  ENST ID: ENST00000426988
  CDS Start-End: 1-678
aggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatgga

SEQ ID NO: 179197 - DNA, 681 bp, Homo sapiens
  Payload ID: 15324
  Gene Symbol: SESTD1
  Gene Name: SEC14 and spectrin domains 1
  ENST ID: ENST00000435047
  CDS Start-End: 253-681
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaa

SEQ ID NO: 179198 - DNA, 1699 bp, Homo sapiens
  Payload ID: 15324
  Gene Symbol: SESTD1
  Gene Name: SEC14 and spectrin domains 1
  ENST ID: ENST00000446758
  CDS Start-End: 1-632
tgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacaggtgcaaaactggttatcttccttttccacaagctcagtgtttgaatagctttctgcatgattataatgtaactttaccttccaagtacaagaagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaa

SEQ ID NO: 179199 - DNA, 10615 bp, Homo sapiens
  Payload ID: 15324
  Gene Symbol: SESTD1
  Gene Name: SEC14 and spectrin domains 1
  Uniprot ID: Q86VW0
  ENST ID: ENST00000428443
  CDS Start-End: 318-2408
cccgggcgcgcgcggggtcgcgcggacgcggctcgggccgcgggtgccgagaggtcgccgggccacccgcacccccgctccccgcctgacgcacggaggggccgggacgcgatttgccgcgagtgactggagccgcagccgtcgccgctgctgccgccgccgcccgggcccgctccgcccccagcccgccttcctcccgccgcgccctccgcctccgcccgcacctcgctagcgttcccctgtcttccccaacgccccggagccgccggccgctagcgtcagcgccagccagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacaggaaatacatatgtaagcatgtgtatataataaataagcatgttttatcatgaaaaattattgtgaacaatttagatctttaagaacttattaataatggaatactatttctaatttttctctttttcaacttgaaaaatattctcaaaattattaactaccctgaagatactttgtctttaggggaggagggctgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttccaatgcaaaaaaaaaacccctcccttttaacctgctagtttttccagccttcttcactgactgacagacttcttggagaaatccacatccagtgcccctacatcctcatcactcactactcagcaccttgcagtctggttttacacagcactctactgaaactgttcttttgaaagtcagcaatggcctcccagttaccaaactgaatggtttttttctccgtctgaatcccttacccttttctctgcaacatttacaccattgagcaacctttcctagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatacttgaatcatcttctcagtcctttggggctttactgctatgagtatgaacttttgtgattatttatttcagtcttcatgatggtgctatcacattctacagttgtttatgtctgtacccagtaagctcttttgagggaaggaatcttgtcttctcctattcccagtcttgctcatgcataacagatgcccattcctcctaaatatgaatgctgtattataggcattagtaataatccctgttacattgcagtctgaagtatgttttaaacatacttttttaaagttagaactgacttacaagtgaatctattcttagattcttagatactaactactttagatatttagttatactcaataactaaatatcaatactcaatatctgtttcttctgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgactcattggtgatgttgatgaaactgctcagcctgccagctgggatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaa

SEQ ID NO: 179200 - DNA, 619 bp, Homo sapiens
  Payload ID: 15324
  Gene Symbol: SESTD1
  Gene Name: SEC14 and spectrin domains 1
  ENST ID: ENST00000440010
  CDS Start-End: 182-619
agacaaagcgccggaggtgggagccctgcgggccgcctttgcctccgcgccgtctgccgggtgcggccgcggcccgcagagaccgggccgcgcgcttttccgttcctgagcgcccttgttcatttctgggtgaaagggacccgaattgtgcaacagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggt

SEQ ID NO: 179201 - DNA, 2957 bp, Homo sapiens
  Payload ID: 15325
  Gene Symbol: SEC14L1
  Gene Name: SEC14-like lipid binding 1
  Uniprot ID: Q92503
  ENST ID: ENST00000392476
  CDS Start-End: 560-2719
actcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcccccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactcccc

SEQ ID NO: 179202 - DNA, 2504 bp, Homo sapiens
  Payload ID: 15325
  Gene Symbol: SEC14L1
  Gene Name: SEC14-like lipid binding 1
  Uniprot ID: Q92503
  ENST ID: ENST00000431431
  CDS Start-End: 211-2256
agtgcatttggtggcagagtgacaggcttggaagagaatgtggagggagtaagggaggcgcttgctaactgcccctgacgctgacagagctctggagaggtcagtgcagcttctgagttagctgctccttagcctggataccttaaatgccatctggttgggcatgccaaggcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgc

SEQ ID NO: 179203 - DNA, 5295 bp, Homo sapiens
  Payload ID: 15325
  Gene Symbol: SEC14L1
  Gene Name: SEC14-like lipid binding 1
  Uniprot ID: Q92503
  ENST ID: ENST00000436233
  CDS Start-End: 265-2412
cggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttccca

SEQ ID NO: 179204 - DNA, 2908 bp, Homo sapiens
  Payload ID: 15325
  Gene Symbol: SEC14L1
  Gene Name: SEC14-like lipid binding 1
  Uniprot ID: Q92503
  ENST ID: ENST00000443798
  CDS Start-End: 212-2371
gagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaa

SEQ ID NO: 179205 - DNA, 5283 bp, Homo sapiens
  Payload ID: 15325
  Gene Symbol: SEC14L1
  Gene Name: SEC14-like lipid binding 1
  Uniprot ID: Q92503
  ENST ID: ENST00000430767
  CDS Start-End: 357-2504
ttcaacagaaaatgagaaatatcccccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactcccc

SEQ ID NO: 179206 - DNA, 705 bp, Homo sapiens
  Payload ID: 15325
  Gene Symbol: SEC14L1
  Gene Name: SEC14-like lipid binding 1
  ENST ID: ENST00000588488
  CDS Start-End: 1-357
tacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccggccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaa

SEQ ID NO: 179207 - DNA, 1791 bp, Homo sapiens
  Payload ID: 15325
  Gene Symbol: SEC14L1
  Gene Name: SEC14-like lipid binding 1
  ENST ID: ENST00000589827
  CDS Start-End: 456-1791
actcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcccccgacgattggctgaaaacatgcagcaaccactattttcttcctgcccctcgttgatgagagcattcgaagtgacctcagcagggcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctgga

SEQ ID NO: 179208 - DNA, 553 bp, Homo sapiens
  Payload ID: 15325
  Gene Symbol: SEC14L1
  Gene Name: SEC14-like lipid binding 1
  ENST ID: ENST00000588880
  CDS Start-End: 508-553
gcgacggggccggcgccttctccgagctcctcccacgctcgcgggtcggagctcgcgcctgcgcagttcgggccccgggtgtcctcccccctcccctttcttagcaaccatcgcccgctcccgcccccgctccctcggccgcggccgcgcacgcgcgcccctcccggcgcccggccccgcccaccccgtcacccgtaacaaccacaagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccct

SEQ ID NO: 179209 - DNA, 637 bp, Homo sapiens
  Payload ID: 15325
  Gene Symbol: SEC14L1
  Gene Name: SEC14-like lipid binding 1
  ENST ID: ENST00000561721
  CDS Start-End: 596-637
actcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtagggcttggacgggaggcgacaaaagagaacttggtttcaacagaaaatgagaaatatcccccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatac

SEQ ID NO: 179210 - DNA, 578 bp, Homo sapiens
  Payload ID: 15325
  Gene Symbol: SEC14L1
  Gene Name: SEC14-like lipid binding 1
  ENST ID: ENST00000588616
  CDS Start-End: 150-578
ttcgatgtttatttgcttggagtttcagcagcagaccgcggtgcttgaagctgttcatggaatgaccgcttgtgtctgagccagcgtctgaggaaactgatgttctataagcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataaccttt

SEQ ID NO: 179211 - DNA, 575 bp, Homo sapiens
  Payload ID: 15325
  Gene Symbol: SEC14L1
  Gene Name: SEC14-like lipid binding 1
  ENST ID: ENST00000586429
  CDS Start-End: 363-575
acacaagggagaaggtggaagtggagactagcgagaggtggccgcaagccaaggaacacccagggcaaccagcagccggaagaagccagaacagaccttcccagagctgcaggagggagcacagctctgccgacactttgatttcacctccagagcttacggcctccagaacagtgagagaatgagtttctgttgccctcagccaccagttcgtggtaatttcttggaacaacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaag

SEQ ID NO: 179212 - DNA, 2712 bp, Homo sapiens
  Payload ID: 15325
  Gene Symbol: SEC14L1
  Gene Name: SEC14-like lipid binding 1
  Uniprot ID: Q92503
  ENST ID: ENST00000585618
  CDS Start-End: 259-2406
aacaaccacaagtgccgtcgccgcgccccttccccctcccgcctccccggccccctccccggaaccggcggtcgagctacggtcgcggagcagtggaaccgagactgccccgcggagccgccgctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctc

SEQ ID NO: 179213 - DNA, 484 bp, Homo sapiens
  Payload ID: 15325
  Gene Symbol: SEC14L1
  Gene Name: SEC14-like lipid binding 1
  ENST ID: ENST00000589202
  CDS Start-End: 1-471
gttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacggtgggtctggcaggggcttcatcccgagagcaaggctagggaagtcggcgttgccgttttctctctgtttgctctgcctgttcccgcttccttggaacattagataactcagaaaggaaa

SEQ ID NO: 179214 - DNA, 652 bp, Homo sapiens
  Payload ID: 15325
  Gene Symbol: SEC14L1
  Gene Name: SEC14-like lipid binding 1
  ENST ID: ENST00000587820
  CDS Start-End: 472-652
tttttgctgagagcggagtttcgggtccggagccagtgcccgcccctctctcccgtcggtcggggctttggccccgtggggctcagccgcgcgggacccctgctgagcagccccgggcgccggccgcccctcgagcctgctcgggatgcgttcagtgggtctggcctttggctcctgtttaaacagcgattgtcatgcaatggaggccgtccggctcctggatgccacttggtcgttgtcactccggatgcccgcgtagggcgtttatctggaccagagcatcggcagctgagacctggctgtggttcacaagctcgtgaattagcaggttcttaactagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagc

SEQ ID NO: 179215 - DNA, 2828 bp, Homo sapiens
  Payload ID: 15325
  Gene Symbol: SEC14L1
  Gene Name: SEC14-like lipid binding 1
  Uniprot ID: Q92503
  ENST ID: ENST00000591437
  CDS Start-End: 446-2491
tctgtcactcaggctggattgtagtggcgcgatctcagctcactgcaacctccatctcctgggttcaagcgattcttctgcctcagcctcccaaatagctgggattacagacctgcactaccatgcccgctaatttttgtatttttagtagagatggggtttctctatgttggccaggctggtctcgaactcctgacctcaggtgatccacccgccttggtctcccagagtgctgggattacaggcgtgagccacctctcctggtctatttttatttttattttttgagacggagttttgctctcgtccaggctggagtgcagtgacgcgatcttggcttactgcagcctctgcctcctgagttcaagcgattctgcatcagcctcccgaatagctgcgattacaggcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaa

SEQ ID NO: 179216 - DNA, 548 bp, Homo sapiens
  Payload ID: 15325
  Gene Symbol: SEC14L1
  Gene Name: SEC14-like lipid binding 1
  ENST ID: ENST00000591786
  CDS Start-End: 1-252
atggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttcc

SEQ ID NO: 179217 - DNA, 388 bp, Homo sapiens
  Payload ID: 15325
  Gene Symbol: SEC14L1
  Gene Name: SEC14-like lipid binding 1
  ENST ID: ENST00000590483
  CDS Start-End: 1-270
gcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaactgctttctctttatctgcaggttcaccctgaaaatgaagattggacctgttttgaacagtctgcaagtttagatattaaatctttctttggttttgaaagtacagtggaaaaaattgcaatgaaacaatataccagcaacattaaaaaa

SEQ ID NO: 179218 - DNA, 1229 bp, Homo sapiens
  Payload ID: 15326
  Gene Symbol: SEC14L2
  Gene Name: SEC14-like lipid binding 2
  Uniprot ID: O76054
  ENST ID: ENST00000402592
  CDS Start-End: 73-1035
gagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagt

SEQ ID NO: 179219 - DNA, 1733 bp, Homo sapiens
  Payload ID: 15326
  Gene Symbol: SEC14L2
  Gene Name: SEC14-like lipid binding 2
  Uniprot ID: O76054
  ENST ID: ENST00000405717
  CDS Start-End: 81-1259
gcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgtaagtatctctgccttggcaatgccttgaagccccatgtccagctttctgcctgtgaggttcctcttcctccatggatttttggctctgagtgttagaactagaagtggaatgccatcagttcaatcctctccttgtatagatgaagaaatctagccttggagacttgtttatggtgacccaactggttaacagcagggtgggactttgatctcatactcctaggtatgggtgagtcacagtcctaggcgatcacaggggttcaacacgtctgctttctggtccaggtctaactgggtctgtgactggacagatatttcttggggatgctccttcccagaggtcacagagacagaactggctgggtgggcatgggatcacaaggtaagcagatgctcaaaagtgcagccttcacccctgagtttcactcatctcccagctgaccaaagaatggacacagactatgagcaggcagtttacacaagaatataagaatgggaaacagacatttgaaaaggtgcttaatctctcttaactttgtaataccattaaaattccccttgactcagcaa

SEQ ID NO: 179220 - DNA, 871 bp, Homo sapiens
  Payload ID: 15326
  Gene Symbol: SEC14L2
  Gene Name: SEC14-like lipid binding 2
  ENST ID: ENST00000428195
  CDS Start-End: 263-871
gctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaag

SEQ ID NO: 179221 - DNA, 556 bp, Homo sapiens
  Payload ID: 15326
  Gene Symbol: SEC14L2
  Gene Name: SEC14-like lipid binding 2
  ENST ID: ENST00000437022
  CDS Start-End: 100-354
gactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagagcctccaaacaggacctgctgaggaccaagatgcgggagtgtgagctgcttctgcaagagtgtgcccaccagaccacaaagtgcaatcatttggcctggactggaacgggcttctgaagtaggacagcctgacaagacttcctgctctctgttccctgcagttggggaggaaggtggagaccatcaccataatttatgactgcgaggggcttggcctcaagcat

SEQ ID NO: 179222 - DNA, 674 bp, Homo sapiens
  Payload ID: 15326
  Gene Symbol: SEC14L2
  Gene Name: SEC14-like lipid binding 2
  ENST ID: ENST00000452649
  CDS Start-End: 100-261
gactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagtgcaatcatttggcctggactggaacgggcttctgaagtaggacagcctgacaagacttcctgctctctgttccctgcagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttg

SEQ ID NO: 179223 - DNA, 485 bp, Homo sapiens
  Payload ID: 15326
  Gene Symbol: SEC14L2
  Gene Name: SEC14-like lipid binding 2
  ENST ID: ENST00000415072
  CDS Start-End: 111-485
actacctgcactttcccgcttcctggcttcccctactggaactgttccctccacctgagttgcccacctctctcccccgctgcctttgaagtccttcaagcccagcacaaatgccatgttttataggaagccgtgtgagaccacctctttcttccctctgctccccagcaaactcctcatccttccatggggcagaagaccatggtggaaagagtgtgtgctctggactcagacagacccggtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctgg

SEQ ID NO: 179224 - DNA, 565 bp, Homo sapiens
  Payload ID: 15326
  Gene Symbol: SEC14L2
  Gene Name: SEC14-like lipid binding 2
  ENST ID: ENST00000429917
  CDS Start-End: 312-565
tttccgggaggctttcttcttgtagggtcagtggcacgatggaaagggctctggatagctccttgggagacttggatagctcctgccccggcaccaagccgctgtgcgaccttgggcaaaaccctgcccttctctttgctcctcgatgccatggaatgaggaggttggaccagatgatgttgaagggaacacctccgtgtgtgaattccaggctccccccatgaggcactgggttggtgttagtttgagctgagaccagccgtcccctatcttgcatcccagacccctgcctggttcaggacttaaggtttatgctcctcagaaggcaagaagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgct

SEQ ID NO: 179225 - DNA, 4382 bp, Homo sapiens
  Payload ID: 15326
  Gene Symbol: SEC14L2
  Gene Name: SEC14-like lipid binding 2
  Uniprot ID: O76054
  ENST ID: ENST00000615189
  CDS Start-End: 261-1472
acacttgctcgcctcctgcctgggtctctgacttcaggagggcggagggggcccgtgtcagagccttccgcgccccagcgcatcgctccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgcagggagtgaaattcaatgcccaccgctaggctcctcgctgcctctcactcaagaggcccaaactcagacggcgtcagggacccggacccagcagccgtttcacgccaatagatagggcgcatgcgcagaaatcctcctcggctctctagcgtgagctttcccaaggggccacgcccagcttgccttctgattggtccagctggtgggttgtcttccgccatctttgatcagggcactaaggatgctccccacggccttcacagtgacggcggagaccctgccccgccagctgctcagtacgtgccgcgtagcccgtgcgagccaagtgtgagtccgggcgagcgcctgcggagctagcactgggcccagaatgagagggaggcggaggagcagcgatcacgtggttttagggactgtctaataattccacgccagcattgccggtgtttcagggggtgggaaccgctgcgttccccatcaacttttctcccacccaccaccctccccaacctacaagcccagctcagcttgaggtaactgctgaccggactgtcctatacagccctacaagacagaggcgcctagggctgaaagcgggggcctccgtagggagccagcgggggcctcaatagttactcattttctctacctttgatgaaaataagagctaattcttaataaggcctaccgggtatcacgcaaaaaccctgtgcttactattacactttgggttgttgcaaagattaaaggaaataagccgtgcaaagcgcttaagagcttggtataagtaagtgctcgtcaatgttggctactctcattttttttgcagacgtgggaactggggctcagggaggctaacagccagtaggcggcacagctaggatttgaacccaggattgtctccaacgccgctcaattatacccgccaaggagtcacagagacttagtgaagtgcacacattgctcacctgggtgaactgaggtccagcgggggaaggcttcctcctgttgtaatcactaaccccaactctgtctcccttgcccgattcattcattcgttaattaattcatccaacatcctgtccccaagaagctcagtctggggacatactgatccagttaaatgcgagtgcttcctagttatacatggcgactgctgagaagggactccagagtccaggcacctacctcccaggggctcaccgttcactcctctagcctcatttagagctcgcattaagagcacgggatctggatccacactgtttggattcaaatcacaacttcaccacttagcagctgtgtgttctgggaaaatgacccaccttctctgtgcctccattttctcacctgtaaaacgggctcccaggctggtgggagggtttcaggtgtaagacatggagagtcctttagcgaacatgtagactggcaataaactcaataaatggtgactgttataattaatcctcggaaccatc

SEQ ID NO: 179226 - DNA, 2632 bp, Homo sapiens
  Payload ID: 15326
  Gene Symbol: SEC14L2
  Gene Name: SEC14-like lipid binding 2
  ENST ID: ENST00000617837
  CDS Start-End: 212-1201
gctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagccagaagcttcgacctgcagaagtcggaggccatgctccggaaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcg

SEQ ID NO: 179227 - DNA, 2086 bp, Homo sapiens
  Payload ID: 15327
  Gene Symbol: SEC14L3
  Gene Name: SEC14-like lipid binding 3
  Uniprot ID: Q9UDX4
  ENST ID: ENST00000215812
  CDS Start-End: 92-1294
gggcaaaaggacccagctgggtcagggctgacaaactaggcttggcctcttgcctatagtggccaccactcctcaagccccagccagcaccatgagcggccgagttggagacctgagccccaaacaggcagagaccctggccaagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaactatca

SEQ ID NO: 179228 - DNA, 1794 bp, Homo sapiens
  Payload ID: 15327
  Gene Symbol: SEC14L3
  Gene Name: SEC14-like lipid binding 3
  Uniprot ID: Q9UDX4
  ENST ID: ENST00000401751
  CDS Start-End: 254-1279
caccactcctcaagccccagccagcaccatgagcggccgagttggagacctgagccccaaacaggcagagaccctggccaaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 179229 - DNA, 1964 bp, Homo sapiens
  Payload ID: 15327
  Gene Symbol: SEC14L3
  Gene Name: SEC14-like lipid binding 3
  Uniprot ID: Q9UDX4
  ENST ID: ENST00000402286
  CDS Start-End: 478-1449
caccactcctcaagccccagccagcaccatgagcggccgagttggagacctgagccccaaacaggcagagaccctggccaaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagagaaagggacacgggagacatcaggggcagacctaagaagtccaagggcctgctgagacctggctttgccatttaccctctgtgagcaaggccctcccctgcaggacctcagctttctcacctgagacaatagcactgtcttccagggagggacagtgctttttataccatggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 179230 - DNA, 2474 bp, Homo sapiens
  Payload ID: 15327
  Gene Symbol: SEC14L3
  Gene Name: SEC14-like lipid binding 3
  ENST ID: ENST00000403066
  CDS Start-End: 285-1346
aaactaggcttggcctcttgcctatagtggccaccactcctcaagccccagccagcaccatgagcggccgagttggagacctgagccccaaacaggcagagaccctggccaaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtggaaagtgagtctgggaagtcttgctgtcatctgcccgtgattatatgcagccatgagctacagaactcacactcaaactcgcaagtgatggcataccaaatggtacgaaaatgcaagctaagtaggcctttacccctccctgccagtaactaatttttgtctgtgtgagtaactggcctgtgtgtaagaggactcaccccctacgtggtctccagttaattctttttcccatttgggctcctgaccgccttgccatgctgcttctaagaggggttatctatactcagagggcctagggcagaccaaggaagggaaagaagttttggaggtttgtttgtttgttttttagagacagggctttgctttgtggcccaggctggagtgcagtggtgcgatcatagctcactgcaaccttgagctcttgggctcaagtgattctcccctctcagcctcctgagtggctgagaccacaggtacacatcaccatgcctgggttttttttctttctttctttctttcttttttttttttggtagagatgaggtattgttacattgcccaggctggtctcaaattcctgacctcaagcaatcctcctaccttggcctcccagtgctaggattacatgtgtgagccaccactcctggtctgggctttttttttttttttttttaggagaatgtaaggcatttgtttagtgtttactgagcatctactgcatgccaagctctgctcaggaggccaagagagcaggataggagtgagccctgcacctggggtttggcctggctggggagccctagcctcaggaagcaggactgccctggaccccaggaggcccctgctcaacctgcgacaagactgaaaggctccccagatgcactgtgacggtcaagggagagaaatgggtgacctgggatcctggtggcttcagatctcattgggggaaggagcaagggaccccaggggtcagaggcattgggggggtagggctgtcagagggcacccagcagagtgactcacaggctatgaggaaagaagtctcctcttgcttgtatcttcaggatgccaagacctgcagcccaggcctggggtggtggttatcccggagcggccttaccaggtgcacagctggccaagggaggcttggtcatgggcagagagggcaggaggaaggcccttgctccaccaccccctctcccaagggagtcctatgcccagaacttaccaagtagcaagactagagcaaccagcagaagacccttgggggcagccatcatg

SEQ ID NO: 179231 - DNA, 693 bp, Homo sapiens
  Payload ID: 15327
  Gene Symbol: SEC14L3
  Gene Name: SEC14-like lipid binding 3
  ENST ID: ENST00000435069
  CDS Start-End: 1-693
agaaaacgtccaggatgtgcttcctgccctgcccaaccctgatgattatttccttctacgctggctccgagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatcccca

SEQ ID NO: 179232 - DNA, 1864 bp, Homo sapiens
  Payload ID: 15327
  Gene Symbol: SEC14L3
  Gene Name: SEC14-like lipid binding 3
  ENST ID: ENST00000434642
  CDS Start-End: 29-184
caccactcctcaagccccagccagcaccatgagcggccgagttggagacctgagccccaaacaggcagagaccctggccaagatggagtctctgtcatccaggctggagtgctgtggagcgatctcagctcactgcagcctctgtctcccaggttcaagcaattctcctgcctcagcctcctgagtagctgggattacagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcacct

SEQ ID NO: 179233 - DNA, 2113 bp, Homo sapiens
  Payload ID: 15327
  Gene Symbol: SEC14L3
  Gene Name: SEC14-like lipid binding 3
  Uniprot ID: Q9UDX4
  ENST ID: ENST00000540910
  CDS Start-End: 351-1322
cagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagagaaagggacacgggagacatcaggggcagacctaagaagtccaagggcctgctgagacctggctttgccatttaccctctgtgagcaaggccctcccctgcaggacctcagctttctcacctgagacaatagcactgtcttccagggagggacagtgctttttataccatggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaactatc

SEQ ID NO: 179234 - DNA, 2499 bp, Homo sapiens
  Payload ID: 15328
  Gene Symbol: SEC14L4
  Gene Name: SEC14-like lipid binding 4
  Uniprot ID: Q9UDX3
  ENST ID: ENST00000255858
  CDS Start-End: 85-1305
acaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 179235 - DNA, 2575 bp, Homo sapiens
  Payload ID: 15328
  Gene Symbol: SEC14L4
  Gene Name: SEC14-like lipid binding 4
  ENST ID: ENST00000320982
  CDS Start-End: 101-217
atctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggatcctcctccgctcagttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtgcggggtttgtgctccctgatcacctctccatcactgcagatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 179236 - DNA, 2564 bp, Homo sapiens
  Payload ID: 15328
  Gene Symbol: SEC14L4
  Gene Name: SEC14-like lipid binding 4
  ENST ID: ENST00000321205
  CDS Start-End: 101-382
atctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggacccaagtccccccagcccacctcctgtccccacgctctgagagcctggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 179237 - DNA, 1603 bp, Homo sapiens
  Payload ID: 15328
  Gene Symbol: SEC14L4
  Gene Name: SEC14-like lipid binding 4
  Uniprot ID: Q9UDX3
  ENST ID: ENST00000381982
  CDS Start-End: 40-1122
cggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggca

SEQ ID NO: 179238 - DNA, 6459 bp, Homo sapiens
  Payload ID: 15329
  Gene Symbol: SEC14L5
  Gene Name: SEC14-like lipid binding 5
  Uniprot ID: O43304
  ENST ID: ENST00000251170
  CDS Start-End: 181-2271
gggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgaggggagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatactgag

SEQ ID NO: 179239 - DNA, 576 bp, Homo sapiens
  Payload ID: 15329
  Gene Symbol: SEC14L5
  Gene Name: SEC14-like lipid binding 5
  ENST ID: ENST00000587469
  CDS Start-End: 70-576
agtcactcctcgccccaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgag

SEQ ID NO: 179240 - DNA, 3392 bp, Homo sapiens
  Payload ID: 15330
  Gene Symbol: SEC14L6
  Gene Name: SEC14-like lipid binding 6
  Uniprot ID: B5MCN3
  ENST ID: ENST00000402034
  CDS Start-End: 1-1194
atgagtggacaagtgggtgacctgagcccatcgcaggagaagtcgctggcccagttccgggagaacatccaagatgtgctatctgcgctgcccaatcctgatgactacttcctcctgcgctggctccaagctcggagctttgacctgcagaaatcagaggacatgctgaggaagcatatggagttccggaagcaacaagacctggccaacatccttgcctggcagcccccagaggtggtcaggctgtacaacgctaacggcatatgcggccacgacggtgagggcagccctgtctggtaccacattgtgggaagcctggaccccaaaggcctcttgctctcagcctccaaacaggagttgctcagggacagcttccggagctgcgagctgctcctgcgggagtgtgagctgcagagtcagaagctggggaagagggtggagaaaatcatagctatttttggtctcgaagggctgggcctgagggatctgtggaagccaggaatagagcttctccaggagtttttctcagcacttgaagcaaattaccctgagatcttgaagagtttaattgttgtgagagcccccaagctattcgccgtagccttcaacctggtcaagtcttacatgagtgaagagacacgcaggaaggtggtgattctcggagacaactggaagcaggagctgacaaaattcatcagccccgaccagctgcccgtggagtttggggggaccatgactgaccccgatggcaaccccaagtgcctgaccaagatcaactacgggggtgaggtgcccaagagctactacctgtgcaagcaggtgaggctgcagtatgagcacacgaggtccgtgggccgcggctcctccctgcaggtggagaacgagatcctgttcccgggctgtgtgctcaggtggcagtttgcttcagatggtggggacattggctttggggttttcctgaagaccaagatgggggagcggcagagggctagggagatgacagaggtgctgcccagccagcgctacaatgcccacatggtgcctgaagatgggattctcacctgcctccaggccggcagctatgtcctgaggttttacaacacctacagcctggttcattctaaacgcatcagctacaccgtggaggtactgctcccagaccaaaccttcatggagaagatggagaaattctaggtgaacctcatggtccccacaccctcctctttgatctctgaatccacaatgagttcacagccttccctggccagaccctgttcaacctctcaggaacagggattctacaacagcaggtcacagcctatgcatcacagctggcccactcctcaggaacggctgggacagtgtcctagtggtggcccgatggtcacagcaaagcaacacagacactccatccccactatgacctgctgtgacctcaagctcagcaaaaaccccaggcttttttctatcaaccaataccaagaaataagttactcttctaaaatatagtattaggccaggcatggtggctcatacctgtaatcccagcactttgggaagccaaggcgggcagatcatttgaggtcaggagttcgagaccagcctggccaacatggtgaaaccctcatctcaactaaaaatacaaaaattagccaggtgtgatggtgcctgcttgtaattccagctacttgggaggctgaggcaggagagtcgcctgaacttggtaggcagaggttgcagtgagccgaaatcatgccactgcactccagtctgggtgacagagtgagactctgtctcaaaaaaataaaataaaatagtattaataggaaatttgaaatatagtatagctgacagatcaggaaataattaccattgaaaagatagtttattactcacagttcccaagaggaggggccgctgtgccatagggggaagaggaggggtccccagggaggcatcagggccgaacatgacgcacatgagacagaaaaactctggacaaagcaactttacttttatgatggtttctgcaggaaggaactggtgaggcagggtaagcaggcttgagatttgctagtttgaataatttcagcaggctccgtggaataagggctgtcactagctgtctggtatcttgccctggggtgattacagcaggtggatagtggcctggagtgtgagaatctgataaaggaggtagttggaatatggtttatatcagttggtttgcattcgaaaagtgcatttgtgggcaagttgctgtatctctaggagaggcaggccctccaggattagcaaaacctcagatgttaaagcatgcagaaaataaaagacatggttcaaatagttccctaacaagcagttgtgcaatgctgctctgaatggaaatccaacctcacagtttcccatctagaaagaattttaaactctctattctgtcttccacatacacgttccctcccactgttatagcatctgagaatctgcttgagctctggatcttcatccaatctcctgattaagatttcaaactggccaggtgcagtggctcacacctgtaatcccagcactttgggaggctgaggcatgtggattgctcgaggccaggagtttgagaccagcctggacaacatggcgaaaccccgtctctacgaaacatacacaaattagttgggtgtggtggcggcgagtgcctgcagtcccagctacttgggaggctgaggtgggagaatctgtggaacccaggaggcggaggttgcagtgagttgagattgcaccactgcactccagcctgggaaacagagcaagaccctgtcttaaaaaaaaaaaattcagactgagcctcacagtgggacactaggtcggtgtcagcccacagtcctactagagtgctgtcctgcgatcaggcctctttgggtctggctatgctgtcagctgagattctgcccaggatcctgtcactcacatgttgtcccagcttgttctcaatgtggcagccccaaatgacagccaaagttcttccctaattgcctactttacaggaatcctgtccaaaaatggaaacacgggcattcagcagcccttgctctccctcagcccctcccctgacagccactgatctgttcttcatccctacacttttgattttttccagagtgtcatataaatggaatcgtgcaatatttagccttttgattctggctttctttagtcagcataatgcctctgagattcattcactttgttgcatgtgttaatatttagttgcttttcgttgctgagtaatataccactgtatggatggaccacactgtgtttatcccttcccctgttaaaggctggttgagtcgcttccagtttgggggcgattatgaataaagctgttgtaagca

SEQ ID NO: 179241 - DNA, 788 bp, Homo sapiens
  Payload ID: 15330
  Gene Symbol: SEC14L6
  Gene Name: SEC14-like lipid binding 6
  ENST ID: ENST00000437871
  CDS Start-End: 1-367
gctattcgccgtagccttcaacctggtcaagtcttacatgagtgaagagacacgcaggaaggtggtgattctcggagacaactggaagcaggagctgacaaaattcatcagccccgaccagctgcccgtggagtttggggggaccatgactgaccccgatggcaaccccaagtgcctgaccaagatcaactacgggggtgaggtgcccaagagctactacctgtgcaagcaggtgaggctgcagtatgagcacacgaggtccgtgggccgcggctcctccctgcaggtggagaacgagatcctgttcccgggctgtgtgctcagatgtcctgaggttttacaacacctacagcctggttcattctaaacgcatcagctacaccgtggaggtactgctcccagaccaaaccttcatggagaagatggagaaattctaggtgaacctcatggtccccacaccctcctctttgatctctgaatccacaatgagttcacagccttccctggccagaccctgttcaacctctcaggaacagggattctacaacagcaggtcacagcctatgcatcacagctggcccactcctcaggaacggctgggacagtgtcctagtggtggcccgatggtcacagcaaagcaacacagacactccatccccactatgacctgctgtgacctcaagctcagcaaaaaccccaggcttttttctatcaaccaataccaagaaataagttactcttctaaaatatagtattaggccaggcatggtggctcatacctgtaatcc

SEQ ID NO: 179242 - DNA, 3910 bp, Homo sapiens
  Payload ID: 15331
  Gene Symbol: SEC16A
  Gene Name: SEC16 homolog A, endoplasmic reticulum export factor
  ENST ID: ENST00000277537
  CDS Start-End: 1-2256
ccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 179243 - DNA, 8982 bp, Homo sapiens
  Payload ID: 15331
  Gene Symbol: SEC16A
  Gene Name: SEC16 homolog A, endoplasmic reticulum export factor
  ENST ID: ENST00000290037
  CDS Start-End: 320-7324
gcgaggagcgcgcccgcgtcagggccccgcgcttctcagctgggcggagtagccgttctcggtgcgtgagcctgctggcatcggtcctgcagactgatttcccgcttgtggccttgattgaagaatcccatctcttctcacatcttaaaacgaaaaaagactgggagaaagagccagcgtaaacagggcgacgtactgggacggccccggcgcgcctggccgggcaggtggcgaggggcggggccaagcgctccaattaaggaacagctatatcctgcttccttctgtaagcagcatcgacttgtgcaagggttcagtcatgcagccaccgccccagacggtcccgtctggcatggctgggccacctccagccgggaatcctcggagcgtgttctgggctagcagcccttacaggagacgggctaataataatgcagcagtggctccgacaacttgcccgttgcagccggtcacggatccatttgcttttagtagacaggcgctccaaagtacaccactgggcagttcgtccaaaagcagtccacctgtcttgcaaggcccagcccccgcagggttttctcagcaccccggtttgcttgttcctcacacacatgccagagatagctctcagggaccctgtgagcccctgcctggacctctgacacagcccagagcacatgccagtccgttttctggtgcattgacaccttcagcacctcctgggcctgagatgaacaggagtgcagaggtcggtcccagttcagagcctgaagttcagactctgccatatcttcctcactacattccaggagtggatcctgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttc

SEQ ID NO: 179244 - DNA, 3073 bp, Homo sapiens
  Payload ID: 15331
  Gene Symbol: SEC16A
  Gene Name: SEC16 homolog A, endoplasmic reticulum export factor
  ENST ID: ENST00000313084
  CDS Start-End: 264-1421
gtctctggatctgcttcccacctccatcctcctggtgtctctgtggatctgctccccacctccatcctcctggtgtctctgtggatctgccccccacctccatcctcctggtgtctctgtggatctgcccccgacctccattctcctggtgtctctggatctgctccccacctccatcctcctggtgtctctgtggatctgctccccacctccatcctcctggtgtgtctggatctgctccccacctccatcctggtgtctctatggatctgctccccacctccatcctcctggcgtctctgtggatctgctcccacctccatcctcctggtgtctctgtggatctgccccccacctccatcctcctggtgtctctgtggatctgctcccacctccatcctcctggtgtctctgtggatcgccccccacctccatcctcctggtgtctctgtggatcgccccccacctccatcctcctggtgtctctgtggatctgctccccacctccatcctcctggtgtctctgtggatctgctcccacctccattctcctggtgtctctgtggatctggcgactctggggcctcacagaaggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagc

SEQ ID NO: 179245 - DNA, 8806 bp, Homo sapiens
  Payload ID: 15331
  Gene Symbol: SEC16A
  Gene Name: SEC16 homolog A, endoplasmic reticulum export factor
  ENST ID: ENST00000313050
  CDS Start-End: 75-7148
tccagctccaattaaggaacagctatatcctgcttccttctgtaagcagcatcgacttgtgcaagggttcagtcatgcagccaccgccccagacggtcccgtctggcatggctgggccacctccagccgggaatcctcggagcgtgttctgggctagcagcccttacaggagacgggctaataataatgcagcagtggctccgacaacttgcccgttgcagccggtcacggatccatttgcttttagtagacaggcgctccaaagtacaccactgggcagttcgtccaaaagcagtccacctgtcttgcaaggcccagcccccgcagggttttctcagcaccccggtttgcttgttcctcacacacatgccagagatagctctcagggaccctgtgagcccctgcctggacctctgacacagcccagagcacatgccagtccgttttctggtgcattgacaccttcagcacctcctgggcctgagatgaacaggagtgcagaggtcggtcccagttcagagcctgaagttcagactctgccatatcttcctcactacattccaggagtggatcctgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttc

SEQ ID NO: 179246 - DNA, 8093 bp, Homo sapiens
  Payload ID: 15331
  Gene Symbol: SEC16A
  Gene Name: SEC16 homolog A, endoplasmic reticulum export factor
  Uniprot ID: O15027
  ENST ID: ENST00000371706
  CDS Start-End: 35-6439
tgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 179247 - DNA, 6465 bp, Homo sapiens
  Payload ID: 15331
  Gene Symbol: SEC16A
  Gene Name: SEC16 homolog A, endoplasmic reticulum export factor
  Uniprot ID: O15027
  ENST ID: ENST00000431893
  CDS Start-End: 1-6465
atgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgatttctgctccagccctgggctaggccgtccgcccgcacctacacacgtgggggcaggcagcctctgccaggcccttctcccaggccccagcaatgaggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctacaggaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttaccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggtgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactag

SEQ ID NO: 179248 - DNA, 4834 bp, Homo sapiens
  Payload ID: 15331
  Gene Symbol: SEC16A
  Gene Name: SEC16 homolog A, endoplasmic reticulum export factor
  ENST ID: ENST00000453963
  CDS Start-End: 1-3180
gctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 179249 - DNA, 3985 bp, Homo sapiens
  Payload ID: 15332
  Gene Symbol: SEC16B
  Gene Name: SEC16 homolog B, endoplasmic reticulum export factor
  Uniprot ID: Q96JE7
  ENST ID: ENST00000308284
  CDS Start-End: 91-3273
cgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattagcttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatgg

SEQ ID NO: 179250 - DNA, 2948 bp, Homo sapiens
  Payload ID: 15332
  Gene Symbol: SEC16B
  Gene Name: SEC16 homolog B, endoplasmic reticulum export factor
  ENST ID: ENST00000464631
  CDS Start-End: 83-1960
gtgggaatttggatgatttctcatgaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacaggtatgcgacctgggagaaaggaaacagtaaggacattttccaagggactgttttagcccttgttgggttttatggatccatttttcattttctcatgtgaatttcagctaccgccggctcccttatttgggattgttatctgtgcaggtctgtgcaaggagatgccccgtgggccccacattacagcattggcgggggcctcaggccacaggtcctcctctgcaaagaggtgggctgatgcctttgtgtggtattgtgccctttggccactgggtggcaccctggctccacaagctaactttgttcctttaaaaaaacaacattttacatgtggaggcttgtgggtccgtgttaggcagccctgggcctgttctgagagcctacccaggcaaaactggaaaatggaagaagtttatgtttagtccctctttggggccctagcatccctacaatgacttggtgcacaagctacttagagtcccactggtgacattctctgttggccatagcattaggcttttcctgcaggaggccctcaatcagctctcagtgaatgaatgcatggacagaacgatttgctccctagaggccctccctgttctgtatctctctatccccctccccatacgtgttaagagtcactaagctcttacgttgtgccaggcattttctttgcactatttcctttaattattacacatttaccctatgaagaagtgaagtgaagcaaagattttaatcgtcacttatggaggaggaaaaccaaggcacagggagatgaaataacttgtctcagatggtacagtgagggtgtgggtgagttggattcggaatccaggcagtcagcctgcaaagcccttttaactgttgcaccacactgcctaccactgaggcagtgtacccagctcattgcctgttccttccaggttcctggtctctgatagcacatggctagcttgtcaaagaatcccttctgtgccaaatgtacaataagtgtgtatgggctaatatgtctcccctcctatgtttacgttggtttatgttgaatgaggaaattcttggaaataaagtcctacccccaggaataa

SEQ ID NO: 179251 - DNA, 525 bp, Homo sapiens
  Payload ID: 15332
  Gene Symbol: SEC16B
  Gene Name: SEC16 homolog B, endoplasmic reticulum export factor
  ENST ID: ENST00000527976
  CDS Start-End: 1-525
actggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaagtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacag

SEQ ID NO: 179252 - DNA, 3277 bp, Homo sapiens
  Payload ID: 15332
  Gene Symbol: SEC16B
  Gene Name: SEC16 homolog B, endoplasmic reticulum export factor
  ENST ID: ENST00000528461
  CDS Start-End: 157-1107
acagtttacagtatctgccagctgtgagtaacagcaggctgtcatgatgggatatagcagaagcagcagcagcaactcctgatttaggggcaatcgatgaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctga

SEQ ID NO: 179253 - DNA, 4228 bp, Homo sapiens
  Payload ID: 15333
  Gene Symbol: SEC22A
  Gene Name: SEC22 homolog A, vesicle trafficking protein
  Uniprot ID: Q96IW7
  ENST ID: ENST00000309934
  CDS Start-End: 897-1820
ctttctgtttaaaattttgcctggatttctgattatttttctcaagacaggtatatatttaaatttattgaggttaaaaggtatgccttcagactcttgttgaaattgccaaatcattttgagaactgtttgtaccagtttttacttccatctgtacttatgagaatgccagacagaagtattattttttaaaaagctaatgtggctgggtgtggtggctcatgcctgtaatcccagcactgtggcaggcgcctatagtcccagccacatcctatgctgtggcatgggaacccaggctgaggcatgagaattgcttgaaccctggatgggggatgttgcagtcagccaagatggcgccactgcactccagcctgggtgacagagcaagatgctgtctcaaaaaaaaaaacaaaaaacaaaaaacaaaagctatatgttaagtgaagcatagtatgttgttttaattagttttttgttttttttttcctcctgagacggagtctcactctgtcgcccaggctggagctcagtgacgcgatttcggctcactgcaacctctgcctcccgggttcaagcaattctcctgcctcggcctcctgagtagctgggattacaggtgtgcaccaccacgcctggctaatttttgtatttttagtagagaaggggtttcatcatgttggccaggctggtctcaaactcctgatcttgtgatccaccctcctcagccacccaaagtgctgggattacaggtgtgagccaccacacctggccattttaattactattcttatattactagtaagttgaacatttttacatatgcttatcaagtttggctttaatttttatgtaacccaaattgttcattttgttttaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccgtaacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatatcagattatttgcacacttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcacactatagccgttgtttcccaaacttcagtctctttagtactacttgtattattttcttaatatttatcttttaaattttaaagtttttttaaaaaaatgaatcctgctccaagtggaaaaccagtatcagtttgccataaataaaaggtaaccacaaaataagtaagatgaacacaaaaaatgttgttcagttctagctagaaactaatgcctagaaaggctccgaatcttaggctctttctttgtggcagtgagggagatgttaccagcaccagcatgaggcactgtctctggaatagtcagaggataaaaggaaactgtaaagggaatgacattctcactgtgattcagcattattctatgttgtgcatcacttaaagacatgttgtgtgccaccagtggcatgggtccgcactatggaaatgcttgactgtagtaagaatcagaaggtggctttcctagcaactcattattttatggctttgaggaattaagcccctagtatctgagagaacttacttgttttttgataacgttttaaagattgtttaagcagttatgaattaataatataggaagcacagttggattccactagcaaaatctataactctcatggttttggaagtcatcttcatgggtgattttcctttgttttttaaagaaaatatttcaaacaaggaattcataggatactgaaatttgatatcatccagaaaaacagatcccattacattgtaattgttgttactaggcatatttattaagtagagaaatagagggtaaaaagttagtgaactgtcttgtttgcgtgaaccagtatttgtggatatgtctagaactgtaaaatcttgcttaactagaaccttagtctgcaccctccttttaggagaatgaggtaaaaggaagacaataagcttatgatatcagggattcatgtaaaacaggaaatagtagttggctccagtcttctcctctaacaaaagtatgcatattctgagagataccccaaggcatcacaagatcctgaatcatcaaaacaccattgaattgtgttgggcattttgtagccaggaaagtgaagtggttcaatttagaaagggtttcaggccaggcacggtgactcaggcctgtaatcccagcactttgggaggccgagacaggcagatcacttgagaccagtagtttgagaatcagcctggccaacgtggtgaaacctcatctctactaaaaatacaaaatttagctgggtgtggttgcgcgtgcctttagtcccagctactcgggaggctgaggcaggagaatcgcttgaacccaggaggtggaagttggcagtgagccaagatcacgccactgtactccagcctggccaacagagcgagactctgtctcaaaaaagaaaggttttctaaactaatggttaaaacagaattttcttgtaaatagggaagttggagcattctggttgagattttgctctgtattgacacagctcgcaccagtttggttcaggagctacctccttgtcattgaattgacgagttacaatgtttggtattcggatacattcagcaagaacacttgaaaactcctcaccaactatttttaaaggcttactttgtttttgtttttattttttcactggctattttggataagaggatgtttacatcttaatgtaaaaaaatgaaaacaggtataaatgttttatgta

SEQ ID NO: 179254 - DNA, 565 bp, Homo sapiens
  Payload ID: 15333
  Gene Symbol: SEC22A
  Gene Name: SEC22 homolog A, vesicle trafficking protein
  ENST ID: ENST00000466950
  CDS Start-End: 78-293
aggccccacaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaacttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtca

SEQ ID NO: 179255 - DNA, 482 bp, Homo sapiens
  Payload ID: 15333
  Gene Symbol: SEC22A
  Gene Name: SEC22 homolog A, vesicle trafficking protein
  ENST ID: ENST00000491366
  CDS Start-End: 179-482
tttcttaggggtcgttcgaatccctgccggcctctcccctcccgctccctgcctctcgccacagcctcggccttcgccctcgggattgaagacctaccccacgggcaggagccaagtccgtgcctttgggatgggagtcggggccgcggagctctggaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatga

SEQ ID NO: 179256 - DNA, 972 bp, Homo sapiens
  Payload ID: 15333
  Gene Symbol: SEC22A
  Gene Name: SEC22 homolog A, vesicle trafficking protein
  Uniprot ID: Q96IW7
  ENST ID: ENST00000492595
  CDS Start-End: 49-972
actcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctga

SEQ ID NO: 179257 - DNA, 572 bp, Homo sapiens
  Payload ID: 15333
  Gene Symbol: SEC22A
  Gene Name: SEC22 homolog A, vesicle trafficking protein
  ENST ID: ENST00000466519
  CDS Start-End: 247-572
agtcctcttcttcctttcttaggggtcgttcgaatccctgccggcctctcccctcccgctccctgcctctcgccacagcctcggccttcgccctcgggattgaagacctaccccacgggcaggagccaattgctgatggggagaggaaaaaatagccactattcaggttccctgtgagttaactgctgctgtacaaaggcaggtgtaatattttctctgtattaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagacc

SEQ ID NO: 179258 - DNA, 870 bp, Homo sapiens
  Payload ID: 15333
  Gene Symbol: SEC22A
  Gene Name: SEC22 homolog A, vesicle trafficking protein
  ENST ID: ENST00000487572
  CDS Start-End: 217-870
ctctcccctcccgctccctgcctctcgccacagcctcggccttcgccctcgggattgaagacctaccccacgggcaggagccaagtccgtgcctttgggatgggagtcggggccgcggagctctggagttgctgatggggagaggaaaaaatagccactattcaggttccctgtgagttaactgctgctgtacaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctg

SEQ ID NO: 179259 - DNA, 673 bp, Homo sapiens
  Payload ID: 15333
  Gene Symbol: SEC22A
  Gene Name: SEC22 homolog A, vesicle trafficking protein
  ENST ID: ENST00000481965
  CDS Start-End: 38-337
cgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaaagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttgg

SEQ ID NO: 179260 - DNA, 1011 bp, Homo sapiens
  Payload ID: 15333
  Gene Symbol: SEC22A
  Gene Name: SEC22 homolog A, vesicle trafficking protein
  ENST ID: ENST00000473494
  CDS Start-End: 146-1011
ctcggagcggcgggtcccgtctcgacagttgctgatggggagaggaaaaaatagccactattcaggttccctgtgagttaactgctgctgtacaaaggcaggtgtaatattttctctgtattaaaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgt

SEQ ID NO: 179261 - DNA, 550 bp, Homo sapiens
  Payload ID: 15333
  Gene Symbol: SEC22A
  Gene Name: SEC22 homolog A, vesicle trafficking protein
  ENST ID: ENST00000480631
  CDS Start-End: 136-550
ctttcttaggggtcgttcgaatccctgccggcctctcccctcccgctccctgcctctcgccacagcctcggccttcgccctcgggattgaagacctaccccacgggcaggagccaagtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatcttt

SEQ ID NO: 179262 - DNA, 6922 bp, Homo sapiens
  Payload ID: 15334
  Gene Symbol: SEC22B
  Gene Name: SEC22 homolog B, vesicle trafficking protein (gene/pseudogene)
  Uniprot ID: O75396
  ENST ID: ENST00000578049
  CDS Start-End: 135-782
agcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacaatatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttttttttttttttgactctaatcaacattccttttgttggtgacatttgtgattttcagtaatctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttctgaggtagaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagtggtaccatagtatttggagcttctataggagtggagaggggcagctcattgttgagagttgcatgctgcaacctaatggtcagcaatgaaataaatacttgtagaatgttcacttcagtgtgaagttttgttatctagttaatttatatacatatatcctttgtagatacatttctatctaatcttgttgggctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatattttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgttgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacgctatattaccaccaagaggtcaaataaataccaaagaatgtattttcgaatttaacaatgaggaacttaatcatacaggcagaagtaattccagagcactggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacaatggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatctgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatatagggtttaataaaacatgtataataaaatatctcatattttaaatttccaccttattggtagctttcatgacaaagggctagggtgctgatggccatacaattaaggtttttggttagttagttagcagaactaactgactcctacctggtgggtttttcttttgtttggttggttggttggttggttttttcccagatggctcaggaggaaggtaaatagcagtcattgtatgtgtgacagagtttgagatagaatgagcatattgaatctcacatcctattcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcattttttgagccgtaagtgtaaggcattttgctggtattattacaatggttatgaggagtttctttgcttgcccaaggtcacatagctagcaagttaaagtagattcaaatccaggcctgctagataccaaattattatttaagagtacttttcactactcctaaataatgacacagatacgtttgtcttacacatttcactttattgtcaagttattagtatgtttattttcaaaagttattttttgcaatttctttttattattccgtactttttaaatttacttcattatcacgtcttcctttattctttttaaatagtttttgcttttgttattttgttttcccttttttactcttggtttgtaatacctctttccttatttgctcctttctcatttgatctcaatgttaatccaactgttttccacatctgattcactaaaattttagcccttaaaaaaaaaattcctgtttttcctatctccttttgtccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctaaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattaaccaaaaattttttaatataactttcaaaaggtattttattacatcatttccatcctttatgtttgggttcaagccctcattaactttaacatggattcttggagtaccctccttactgattttgttacacatgtccctcttttagtcagtactaccatgataataccatggataataattttttcatttttatttttagtcttgctctgtcgccgaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttgtgtgtgtgtgtgctaatcatactacattttctttagaataaaagatcacatacttgtttgccattcgcagtctggccccattgtgccattctagacttacctcctgccactccccaccagctttgttttgtcttagccacacaaaataatctagcgtctctaaccagtcaaacattttaccttgtgccttggctcactctgtgccttttctccagaatatctttctgtgtacttttctcccatccttttacctttaaacctgctgctatggtttgcatgttgtttggcccctccaaaactcatgttgtagttcaattgccaatgtaatagtgttgggagatggtacttttaagaggtaattaggttgctaagatggattaacatctttctcttgacactgagactgggttctcctgggaatggttagttcccaagagagtgagttgttataaaacaatgctgcctcttctattttgcgctttttgtttgcac

SEQ ID NO: 179263 - DNA, 2230 bp, Homo sapiens
  Payload ID: 15334
  Gene Symbol: SEC22B
  Gene Name: SEC22 homolog B, vesicle trafficking protein (gene/pseudogene)
  ENST ID: ENST00000618538
  CDS Start-End: 1-240
tacattgacagtcgtgctcgaagaaatctaggctccatcaacactgaattgcaagatgtgcagaggatcatggtggccaatattgaagaagtgttacaacgaggagaagcactctcaggctggagtgcaatggcacgatcttggctcactgcaaccaccatctcctgggttcaagcgatcttcccaccttatcctcctgagtacctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttgtttctcagtccctgactcttcttccgtgactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacaaccggattgcaaaatagttttttctgaaatttcaagaagtgaaaagtttgatcagaatttattatgtcaaatggagagtttgtgtttattattaaaatatgccttatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatgggttatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacatcatctgatcagcatcatcagttaattagtatatgcaatgttagccttaaaataaaaatgatgatttaagattc

SEQ ID NO: 179264 - DNA, 1380 bp, Homo sapiens
  Payload ID: 15335
  Gene Symbol: SEC22C
  Gene Name: SEC22 homolog C, vesicle trafficking protein
  Uniprot ID: Q9BRL7
  ENST ID: ENST00000264454
  CDS Start-End: 145-1056
ctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatac

SEQ ID NO: 179265 - DNA, 1608 bp, Homo sapiens
  Payload ID: 15335
  Gene Symbol: SEC22C
  Gene Name: SEC22 homolog C, vesicle trafficking protein
  Uniprot ID: Q9BRL7
  ENST ID: ENST00000273156
  CDS Start-End: 211-963
agcagcagcgaatgcggggtaggggggaggtggggtggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttatt

SEQ ID NO: 179266 - DNA, 752 bp, Homo sapiens
  Payload ID: 15335
  Gene Symbol: SEC22C
  Gene Name: SEC22 homolog C, vesicle trafficking protein
  ENST ID: ENST00000383750
  CDS Start-End: 134-352
tgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaagacaaggtcttgccatgttgcccaggctggtcttaaactcctaggctcaagtgatcctcccgccttggccttccaaagccctgggattatagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctg

SEQ ID NO: 179267 - DNA, 1446 bp, Homo sapiens
  Payload ID: 15335
  Gene Symbol: SEC22C
  Gene Name: SEC22 homolog C, vesicle trafficking protein
  ENST ID: ENST00000449617
  CDS Start-End: 145-576
ctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcg

SEQ ID NO: 179268 - DNA, 872 bp, Homo sapiens
  Payload ID: 15335
  Gene Symbol: SEC22C
  Gene Name: SEC22 homolog C, vesicle trafficking protein
  ENST ID: ENST00000456515
  CDS Start-End: 163-872
actctgtcacgcggagcctccccgcctccagacgtcagtccggttgctaccccggcaggaatcgagcttagatcacgaaggctccttctcacctccggacgtgagaattacaggcttggatctcaaaccgccgcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttcca

SEQ ID NO: 179269 - DNA, 527 bp, Homo sapiens
  Payload ID: 15335
  Gene Symbol: SEC22C
  Gene Name: SEC22 homolog C, vesicle trafficking protein
  ENST ID: ENST00000416880
  CDS Start-End: 206-527
acctgcgcctgggctgccggtgacctgggccgagccctcccggtcggctaagattgctgaggaggcggcgggtagctggcaggcgccgacttccgaaggccgccgtccgggcgagcaacttggagccttaatagaatctacagatttggtaaccagttctcaagtcctgtggctgaaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctcca

SEQ ID NO: 179270 - DNA, 721 bp, Homo sapiens
  Payload ID: 15335
  Gene Symbol: SEC22C
  Gene Name: SEC22 homolog C, vesicle trafficking protein
  ENST ID: ENST00000450981
  CDS Start-End: 294-721
gaggagcctccagccagcgctcctatacctgcgcgttccctgtttgcccccccctttgaagtcagtcgcccaatctgaaagccgtggatgcgcctgcgccctccatctcgtcagtagagacggggttccactgtgttagccaggatggtctcgatttcctgacctcgtgatccgcctgcctcggcctcccaaagtgctgggattacaggcgtgagccaccgcacctggactgattggttttttaacatcattaaagtttctatcaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcagga

SEQ ID NO: 179271 - DNA, 823 bp, Homo sapiens
  Payload ID: 15335
  Gene Symbol: SEC22C
  Gene Name: SEC22 homolog C, vesicle trafficking protein
  ENST ID: ENST00000445388
  CDS Start-End: 170-388
aagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaagacaaggtcttgccatgttgcccaggctggtcttaaactcctaggctcaagtgatcctcccgccttggccttccaaagccctgggattatagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagttt

SEQ ID NO: 179272 - DNA, 1513 bp, Homo sapiens
  Payload ID: 15335
  Gene Symbol: SEC22C
  Gene Name: SEC22 homolog C, vesicle trafficking protein
  Uniprot ID: Q9BRL7
  ENST ID: ENST00000417572
  CDS Start-End: 149-901
ccagtttccagctcacccggctcccggttgatctcgatgtcgaagtggcactgcggccggtcctgcgcccccatcgcgaccgaggtggcggcaagagctgggagagagggggagaaaagcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggctt

SEQ ID NO: 179273 - DNA, 553 bp, Homo sapiens
  Payload ID: 15335
  Gene Symbol: SEC22C
  Gene Name: SEC22 homolog C, vesicle trafficking protein
  ENST ID: ENST00000420163
  CDS Start-End: 328-553
cggtgacctgggccgagccctcccggtcggctaagattgctgaggaggcggcgggtagctggcaggcgccgacttccgaaggccgccgtccgggcgagatttacacatgtacctccagagccagaaggataaagcactcggggaaaaattagttttgttttttgtttttttgtttttgacggagtctcgctctgtagcccaggatggagtgcagtggtgtgatcttggctcactgccatctcagcctcccggattcaagcgattctcctgcctcagcctcccaagtatctgagactacaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaactactagacattttaaaggaagcggaagaaagacagtctcagg

SEQ ID NO: 179274 - DNA, 780 bp, Homo sapiens
  Payload ID: 15335
  Gene Symbol: SEC22C
  Gene Name: SEC22 homolog C, vesicle trafficking protein
  ENST ID: ENST00000454141
  CDS Start-End: 133-318
gggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacagtgagcagtaccatagcttttaatagtaaggagtgtgttagttccctaaggctgccataacaaatgaccacaaactggcttcaaacaacagaattcgttctctcacagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccagg

SEQ ID NO: 179275 - DNA, 1458 bp, Homo sapiens
  Payload ID: 15335
  Gene Symbol: SEC22C
  Gene Name: SEC22 homolog C, vesicle trafficking protein
  Uniprot ID: Q9BRL7
  ENST ID: ENST00000423701
  CDS Start-End: 125-811
ggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 179276 - DNA, 5955 bp, Homo sapiens
  Payload ID: 15335
  Gene Symbol: SEC22C
  Gene Name: SEC22 homolog C, vesicle trafficking protein
  ENST ID: ENST00000451653
  CDS Start-End: 1-676
agcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataacactggttttagtcattgagagttgtctccaaggaaccactttaaaatccaaatcagctttcagtctaaacataacttgattagttttttttttcagagggtcagtacaggatgaattaaaaacctaaaaatatggttcataaatgtaagctagataaattttgtttacattttttcaatatcttaggttcgatatacctttggaatatttaattatattttggatataaattggacttcatttagggtgagggcaaacttaagctgagaaaatggttaagaaatctgagtttatttaatttatatgtaaccttttatagtggtgggactgtttgggtacagagatgttttatatttatttgcagggtatatccgaatattttaaaaattaattgaataaccagtacttctagatgataagtttgtcagcatgagcagaaatgagaatttcaggattacttacaattgaccacaacctggagtaggtgaatgaacatggattcagtggcactttacagatccgcttgggaggggctgctgtcatcagccttttcagtagagctgagtgcctgttgttttaatgatgatgactactgtaccctgtgtacctgttcccagagcgcctccaaaattaattactcctctgcacctttcccagtcatcttaattagcttgagggcctcattttttatgaacaagagttaagtatctgttaactttttaaagcttgatagagatataattaacacatactctggaaagttactctctttcactgtcaaaaaattgattgatcacagttttccaaaatatggttctggataagatcccttaggtttcccgaaatttcagcctggcttgttttgtaccacgcaggaggtcattttgggagtttgctctttggattgttcttggtagaagtctggaatctgaatagttcaaccacagttgcatggaacactttgagtgttcaactgcattatgtggtcttgataaatttttaaaaatcctattttgatagtttttaaaagtggaaaaccattacaagagttgagtggatagggaatgtaagaatgtagttttagaaaaattcaattatatttggttatcactggtattgtattgttattgagctaccttgttatcattttaagaaaaataagtttatatactgggaactatgttgggaaaatgttgccatagtaactttattttttataatagaattttctatttttgaccaaacataaaatatttggatatgggccaggcatgatggctcatgcctgtattcccagcactttggaaggccaaagcaggagactcggttgaggccagtagtttgagaccagcctggacaacatagtaagattcatctctacaaaaaaaaaaattagccggatgtgatggcacatgcctgtaatcccagcactttgggagtctgaggcaggaggatcccttgagtccaggagtttgaggcttccatgagctataatcacaccactgcaccccagcctgcatgacagagtgaaaccctgtctctaaaaagtctgaatatgaaaattatattggcagcatactcagacataaactccaaagttgtctctacactgatttcacatctgcataattttctgcatacccagcaggtgaattttcagtttttctgggagacaattttgaagagatggtgaaatagaatgggaagttaaggaggggaggtaaaatgttttaaatgagaagaacaaaaaagctttaaaagtcaataacactttgggaagctgaggtgggcagatcacgaggtcaagagatcgagaccatcctggctaacatggtgaaaccccatctctactaaaaatacaaaaattagctgggcacggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaaaagtcggtaagaacggcttaaaaatggactgttttcttttcctatgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatatcagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatccgagggaaatccccaggcttaggtttgacttggttcagggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcattccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacacttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgcttgcttgcatagtgcagcacaagtgaggacaggcaggggtgggagcatttatggtgatcagatgtgcctggcaagcccctgttcagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccagggtgctgttatgagggtcaaaagtggtagtggagggtaatactgggtgagtccattgtgtgtgggaggagaaaggctttacattcacctggtacatgaaggtttttctgcttcaggcagcacagcacagccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 179277 - DNA, 4135 bp, Homo sapiens
  Payload ID: 15336
  Gene Symbol: SEC23A
  Gene Name: Sec23 homolog A, COPII coat complex component
  Uniprot ID: Q15436
  ENST ID: ENST00000307712
  CDS Start-End: 519-2816
acgctgtggctttagggagctgggaaaggcgctctctcccggtcccgctctgcccggtcccacgcccctcggccgtccggctgcctgggtcttccgggttcttccgcccctctggctcggtccccgctacctctcctccctcctcccctctcggtaccttcgcccgccgcgcgcctttctcaaatcctccggttattaagcaagctcaggggtccggtggcctgccctggtaactctgcgcccgccccttcctgcccccttcctgccctcacgccccgtcccctcctcttgacgtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgt

SEQ ID NO: 179278 - DNA, 4215 bp, Homo sapiens
  Payload ID: 15336
  Gene Symbol: SEC23A
  Gene Name: Sec23 homolog A, COPII coat complex component
  Uniprot ID: Q15436
  ENST ID: ENST00000537403
  CDS Start-End: 1204-2895
tctcgctctgtcacccgggctggagtgcggtggcacgatctcagctcactgcaacctctgcctcttgggttcaagcgcttctcttgcctcagcctcccaagtagctgggattacaggagcataccaccatgccttactaatttttgtatttttagtagagttggtgcttcaccatgttagccaaggttggtcttgaacttctgaccttgtgatttgcccaccttgacctcccaaagtgctgggattacaggcatgatccaccgcacctggccctaatttttgtatttttagtagacatggggtttcaccatgttggccaggctggtcttgaactcctgacctcaggtgatccacccgcctcggcctcccaaaatactgggattacagctgtgattcactgcgcctggccacatcttccttttttcaataggcaagtgaatgcctgcagactgaattttttttctccattgaaacatgtttattttctttccctatttagattaaatttccctattctttccctattattagttgaaaagagcctggcctttgctccccagatagtcctggattcaaatcttaaactcttctggttgtatgatcctgggtttttgtctttgctgattgtgtcatccttcatagaaaggaataaactacctattttgccaggttattagtactaaatatgaaattctcaatatggtgtaaacccttatagagctttatagaaaaacctggatttaaaatcttgctttgttacttactgattgtgtaacctcagacaaattacttagtctttctgattgtcaattttcatttataaagtagaatttaagaagaaatctatttcattattgttttgtgaggaaatagtatatataaaggttttagcatagaatatggaacatattaagttcttagtaaagagttgctgtttctgctaacagtataggaaatattgcaggattagttcactaattttatctttgtacatctttagacttcagttttctgttacacagttttataactccagtacttcatgactaagcatttctagattcaagaaaaatttagtataacattattttcatttgtctagagagaaattgtgcacatatctgaaattcaaaacaaaggtggcagttcgtagtttggttatgaattacattagaaaatcaagatgtatataggtacaaagaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 179279 - DNA, 2734 bp, Homo sapiens
  Payload ID: 15336
  Gene Symbol: SEC23A
  Gene Name: Sec23 homolog A, COPII coat complex component
  ENST ID: ENST00000545328
  CDS Start-End: 226-2436
gtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgt

SEQ ID NO: 179280 - DNA, 907 bp, Homo sapiens
  Payload ID: 15336
  Gene Symbol: SEC23A
  Gene Name: Sec23 homolog A, COPII coat complex component
  ENST ID: ENST00000548032
  CDS Start-End: 203-529
gttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcaggtaagaaaacatccattgcatgccgggcgcagtggctcatgcctgtaatcccagcactttgggaggccgaggcgggtggatcacgaggtcaggagattgagaccatcctggctaacacagtgaaaccccgtctctactaaaaatacaaaaaaaaaattagctgggcgtggtggcaggcgcctgtagtcccagctactcgtgaggctgaggcaggagaatggcatgaacccgggaggtggagcttgcagtgagccgagattgcaccactctactccagcctgggcaacagagcaagactccgtctcaaaaacaaacaaacaaaacaaacaaacaaacaaatgaaaaaaaacccataaaacatccattgcagatgttaatgccaaaatactagtcatgtagaaaaatgcatatttaaaaaaagataca

SEQ ID NO: 179281 - DNA, 588 bp, Homo sapiens
  Payload ID: 15336
  Gene Symbol: SEC23A
  Gene Name: Sec23 homolog A, COPII coat complex component
  ENST ID: ENST00000555017
  CDS Start-End: 82-588
gtgattctcggaatcaaccagggtcctaagatgtcctggaggccgtctccatttctctcgaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattactttt

SEQ ID NO: 179282 - DNA, 571 bp, Homo sapiens
  Payload ID: 15336
  Gene Symbol: SEC23A
  Gene Name: Sec23 homolog A, COPII coat complex component
  ENST ID: ENST00000556092
  CDS Start-End: 150-571
ggcagaggcggcgccagccatgttggccgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaaga

SEQ ID NO: 179283 - DNA, 574 bp, Homo sapiens
  Payload ID: 15336
  Gene Symbol: SEC23A
  Gene Name: Sec23 homolog A, COPII coat complex component
  ENST ID: ENST00000553970
  CDS Start-End: 234-494
ctcttgacgtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgcagtctgttctctacccagaagctagagttttatgaatgaaaatcagatgatgaacatcttccagtagtagcttcttattcttggaatgagaaatacaaactccttatcaagatctataa

SEQ ID NO: 179284 - DNA, 547 bp, Homo sapiens
  Payload ID: 15336
  Gene Symbol: SEC23A
  Gene Name: Sec23 homolog A, COPII coat complex component
  ENST ID: ENST00000555425
  CDS Start-End: 267-547
gttctccttcctcagcctccggagtagctgggattacaggcgcatgtcaccatgcccggctaatttttgtatttttagtagagacggggtttcactgtgttagccaggatggtctcgatctcctgacctcatgatccgcctgcctcggcctcccaaagtgctgggattacagatagatgtgatttgtgattctcggaatcaaccagggtcctaagatgtcctggaggccgtctccatttctctcgaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcaggt

SEQ ID NO: 179285 - DNA, 575 bp, Homo sapiens
  Payload ID: 15336
  Gene Symbol: SEC23A
  Gene Name: Sec23 homolog A, COPII coat complex component
  ENST ID: ENST00000557437
  CDS Start-End: 456-575
aggctgactaaaatacataaatagtacgtgaattctttcgggccagggatctgggcctactttgcctgcatcatattaccagcatctcaattgtgtctggcacatagtaagtttcagtaaacatttgttgcactaagtgaaagaatgaacttttcacttttttcagagatgtgatttgtgattctcggaatcaaccagggtcctaagatgtcctggaggccgtctccatttctctcgaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagcc

SEQ ID NO: 179286 - DNA, 561 bp, Homo sapiens
  Payload ID: 15336
  Gene Symbol: SEC23A
  Gene Name: Sec23 homolog A, COPII coat complex component
  ENST ID: ENST00000557280
  CDS Start-End: 224-481
ggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtctgttctctacccagaagctagagttttatgaatgaaaatcagatgatgaacatcttccagtagtagcttcttattcttggaatgagaaatacaaactccttatcaagatctataa

SEQ ID NO: 179287 - DNA, 261 bp, Homo sapiens
  Payload ID: 15336
  Gene Symbol: SEC23A
  Gene Name: Sec23 homolog A, COPII coat complex component
  ENST ID: ENST00000625395
  CDS Start-End: 1-261
atgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgcagtctgttctctacccagaagctagagttttatgaatga

SEQ ID NO: 179288 - DNA, 3176 bp, Homo sapiens
  Payload ID: 15337
  Gene Symbol: SEC23B
  Gene Name: Sec23 homolog B, COPII coat complex component
  Uniprot ID: Q15437
  ENST ID: ENST00000262544
  CDS Start-End: 491-2794
atcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctaggtgagcggctccggccaggtgagcggggcgcataggtgacggagggccgagggcacggttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctga

SEQ ID NO: 179289 - DNA, 3411 bp, Homo sapiens
  Payload ID: 15337
  Gene Symbol: SEC23B
  Gene Name: Sec23 homolog B, COPII coat complex component
  Uniprot ID: Q15437
  ENST ID: ENST00000336714
  CDS Start-End: 433-2736
atcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 179290 - DNA, 3229 bp, Homo sapiens
  Payload ID: 15337
  Gene Symbol: SEC23B
  Gene Name: Sec23 homolog B, COPII coat complex component
  Uniprot ID: Q15437
  ENST ID: ENST00000377465
  CDS Start-End: 251-2554
gcttctgggaggaggccttttcttgacagtttagggtagcgggggaatggatgatccgggagtcccctgcggatgtcgtcccgcaccaggccgggaccgatttctggctccagtttccccagaattgcggagtgcgcacacctggaaggacccaagtcccgttttatagttgagaaactcaagactcagacaagtgaaacgacttttgcttcatgacagctggaactggaacccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 179291 - DNA, 3405 bp, Homo sapiens
  Payload ID: 15337
  Gene Symbol: SEC23B
  Gene Name: Sec23 homolog B, COPII coat complex component
  Uniprot ID: Q15437
  ENST ID: ENST00000377475
  CDS Start-End: 427-2730
aggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctaggtgagcggctccggccagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctgaggtctctgtgtgagtgtgtatgtgttttaagtgacttccttaagaggtgtttcctgaacctaattctcataattaaagtaatgtatatgcaggatcaaaatgaaacaaatataccttatcctaaagagctcataacaaataagttacctccactctataaactcagacctactttttgaagataactgcttttaacctctccttacaagatttttgttgttgatgtatttaattttagcccatgtctcaattctcattttcaaagaatcaatatattaatatacctttggtca

SEQ ID NO: 179292 - DNA, 1184 bp, Homo sapiens
  Payload ID: 15337
  Gene Symbol: SEC23B
  Gene Name: Sec23 homolog B, COPII coat complex component
  ENST ID: ENST00000450074
  CDS Start-End: 192-1184
cttcttccggcagccttagtttcttccaaccagtgcagctccctgttccgcgagcatacgtcatcgttctcgctttccggtagctaaggcgatcagcgggacttcccactgagacgagcggatgtcatattgtatcagggcgaacctctgaggagcgctggctgcgcttaggcaacgttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaag

SEQ ID NO: 179293 - DNA, 834 bp, Homo sapiens
  Payload ID: 15337
  Gene Symbol: SEC23B
  Gene Name: Sec23 homolog B, COPII coat complex component
  ENST ID: ENST00000422877
  CDS Start-End: 1-741
cagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagat

SEQ ID NO: 179294 - DNA, 7168 bp, Homo sapiens
  Payload ID: 15338
  Gene Symbol: SEC23IP
  Gene Name: SEC23 interacting protein
  Uniprot ID: Q9Y6Y8
  ENST ID: ENST00000369075
  CDS Start-End: 73-3075
gcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaataaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggacacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagcaaacttatgtatttctcttgtcttccttaaaagtgtccccatgaactcagtgtttattcccttttcattttgagtacctgcttatatggtcagtatgtaacgttagcattggctcctaatggtagaattagaacagcaagattgtagagctgtaattgactccagacaacatagatttcagccacctcattctacagctgaggccaggacaataaatgcctttcccagactgggtagtggcagatctgggatggaatatggttttcttgattccctttcagccttcatttctctctctcaggactactactttttaattacttttcacttaatttcccaatactgatgaaataaagaaaaatgagggttatttatatacatttcaataaaatccaatttgatttttcaacttacatctgatttttgtttgtgtcattcagcctgtcttctgagtaatgggcagagaaggaccagggttcgtagaagaagcatgtggcagctgagtggcagcagtcttgccctttcattttaatacttgagtacacagaaaatagaatttttgagtgactctgcctgtggatatatatactcatacatacatatatatatatacacacacacatatgtatgtatgtatgtattactattcagtctcttaaaaaccaaaaaacagtagatcccctgagggtagagtctttatgtatgaacatattgttcactgttgtaaccaccttgcaggatttcagtctataaactaggtgagaatccagctgctgagtgaagcttgatctctgcctcttcctcaggagcagctcatcccctgacaacctcccctcccagcccctaatctggtttaatgccctccttttccccagataaagaaagtcatgtctgtagttattccaaaagtgtttcatgtgtagagtttggcacaaaaagtaaaaagcgccagcatctgaagtcaaaggtgaaagagtcatcacagtactgatgaagacacccaggcctcgtcagctatgttaacgtgctgtatgacaagaggaacctgctttctaagtctgctggacacgcgtgcttcttgaatccaaccagacaagcatgttttctcaaaaccacagtataagacaaggaaactgcacagattcgagtgatttttgaggtaagtatgttattggaaaggtgtgatctatatagaaccctgtacatgaaaaggaggagatgccgctatcttggcagggatgatcatgtatttgaaatagtaactcacagcatttggtctcatgataagagtactgaagattatcccagaaaacctaggatgattggtatttatagtaccattgtttcaggtttttatgacttgaggcatctaactatcttaatgctgtactttagtgtttaccaagcagctttctggtggaaacttgaactgcagacactgagtgttttggttttcctccaagttatagttctcattgtaacttaataagttggcattccagcttagtttgagtcagtttcccagggctgggtcctcagaggagagtggatagaattcagttcctctatgagctggggtgctgacattgtgttcctgctgttgactgtccctgcggtgcacgggacagactgtcagctaacctgtcttcatgacatttctataatactcctcagggggttaaccccatctctactaaaaataaaaaaaattagctgggcatggtggcatgtgcctgtagtcccagctacaggaggctgaggcaggagaattgcttgaacccaggaggtggaggttgcagtgagttgggatctcgccactgcactctagcctgagtgacagagcgagactctgtctcaaaaaaaaataaatgaataaaaaataaaacagcaactcttgcagatttcccgaatgtattggtcccagagaacactgaaaataatgtcatgttgttaacaccagtgggagtttgggaaataattccagctctttaatacttctttcagcttcagattaagtgaaatgagtttcacatatttcaatatatgaaattttatgatgacacataaaacaggccaggggttattgaggacacatctgtgagatagtgggcaatgctacatattcgttagtggatgtgctgcagttcaggttcatggacaggtgggactggtgtggttgggataacccaccatgtttgtctttcatttcttgtataaagagtggtttttaaaagaccttactatggaattttcacaaatactcaaaagtatggagaatggtacagtgaatccccatgtgcccttttcccagcttcaggggtggtgtcagtgataatgatttggctctgtgtccccacccaaatctcatcttgaattgtaatccccacgtgtcaggggagggacctggtgggaggtgattggatcatgggggctgtttccccatgctgttcttgtgatagtgagggagttctcacaagatctgatggttttaaaagtggcagttttccctgcactctctcctgccaccttgtgaagaaggtgcctgcttcccctttgcctttcgtcacaattgtaagttccccgaggttcgtcatgattgtaagtttcctgaggtctccccaaccatgcagaactgtgagtcacttgaaccccttttgtttataaattgcccagtctcaggtagtaccttgatagcagtgtgaaaatggactaatacagtcagggacctaaaagacaggtaaagagatgtggccaggtgaagacggaaaaaggacagtgcattccagacctgtggaaagacgcgaggttggaaagaacatcacaactggggcgactgaagaaattatgttgttaagcacgaaatgcagagagagagctatgtgaatgtgttgagtgtgattttcattaaacaatttttaaagaaag

SEQ ID NO: 179295 - DNA, 582 bp, Homo sapiens
  Payload ID: 15338
  Gene Symbol: SEC23IP
  Gene Name: SEC23 interacting protein
  ENST ID: ENST00000446561
  CDS Start-End: 1-582
gagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacggg

SEQ ID NO: 179296 - DNA, 782 bp, Homo sapiens
  Payload ID: 15338
  Gene Symbol: SEC23IP
  Gene Name: SEC23 interacting protein
  ENST ID: ENST00000442952
  CDS Start-End: 1-460
ttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggtacgggtgctttatttctttatgagtttctttaaaaaatgtaggtcctatatacattggtgagtaacatcattcacagtggagcggactttacttacaagacagcttgttttgatgctgttcacagagaagattactttttaagtggtgtcatcactcatgaggtgctaatcgtggcatctgtgtctaaagatagaatatgatttgcagagacacatcacagatctaataaggtgcttgtgtcaagccttcaatagaacctaggccgctgggatttgttgttgatagaagatgccaagcatatggacattttcaaattagtattcagtaaaaggcttgaaattaacctctgatttgtgaaaataaataaatagaattggaagaa

SEQ ID NO: 179297 - DNA, 1461 bp, Homo sapiens
  Payload ID: 15338
  Gene Symbol: SEC23IP
  Gene Name: SEC23 interacting protein
  ENST ID: ENST00000543134
  CDS Start-End: 1-1461
atggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgatttagggtggtttctctcaaattgctgcggacacatttcaagaaatctttag

SEQ ID NO: 179298 - DNA, 2700 bp, Homo sapiens
  Payload ID: 15339
  Gene Symbol: SEC24A
  Gene Name: SEC24 homolog A, COPII coat complex component
  Uniprot ID: O95486
  ENST ID: ENST00000322887
  CDS Start-End: 254-2095
ctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagagtgtcattggggtcagttcagaagaaactcttattacctgcctggaaattgccatgagataatacagtgagaggtgaacagaatgtgtctgaaggggggatgttgtctaccctgtacatgcatatatgccgtaggggtaacattttaactagcaagtctatggtctctgctgttggcaatggtgactgtgccatagtgcgaagtatttttttccccattaactctatttgtacaacctaacctgtaaaggtagttgtttttcttttgtagtgatattactagttggcaaagttactggatatcttagatttgcaacagggaagagctaaactcgctttggaacttacaagaataaagtatgtagaggtgatggagaaggccatatttcatggcattaaaatacatcaaatctctaaactgtgatggttcttttggatacattttggacttatagtcttgctggactactgcatgtgcaagaactgtaaggcccaactttgatttgtcttgcttgccaatttataatgttgacttaaaatggctttcttgtcatttgaccaacttcattgtttagtgtctgtagattctctgaccatcatcatgactcaatgtcttgtctattgtatgagatactgacttaatgtgaaataaaattttaattatgaca

SEQ ID NO: 179299 - DNA, 6299 bp, Homo sapiens
  Payload ID: 15339
  Gene Symbol: SEC24A
  Gene Name: SEC24 homolog A, COPII coat complex component
  Uniprot ID: O95486
  ENST ID: ENST00000398844
  CDS Start-End: 289-3570
ccggccagggcctccctccttctctctaggtttggctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaa

SEQ ID NO: 179300 - DNA, 650 bp, Homo sapiens
  Payload ID: 15339
  Gene Symbol: SEC24A
  Gene Name: SEC24 homolog A, COPII coat complex component
  ENST ID: ENST00000513123
  CDS Start-End: 1-452
gttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagaggtaaggcacattttcctacctgacatgtttaattgaaatattgaaggaatatgtttttgaaatgaactttaagtaaaattttgattatttctgtgacatttctaagatgtgtagcattttatatttgctcttataattagatgaacagctcttgagttcaaccttgagctgatcatttttaagtctaatgaagcaagttatttgtagtagggtagaaaataagcatattccata

SEQ ID NO: 179301 - DNA, 5083 bp, Homo sapiens
  Payload ID: 15340
  Gene Symbol: SEC24B
  Gene Name: SEC24 homolog B, COPII coat complex component
  Uniprot ID: O95487
  ENST ID: ENST00000265175
  CDS Start-End: 56-3862
cccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttgacagtatggtttggtgattttttggggtttttgtttgattggttttttgtggggattggtgggtttttttacatacaggatgtattgaatttactaattggggaagtgcagtgatactgcatttcagttagtaatatatatgaatcaggccaggcgcggtggctcacgcctgtaatcccagcgctttgggaggccaaggtgggcagatgacttgaggtcaggtgttcatgacctgcctgaccaacatgatgaaaccccatctctgctaaaaataccaaaattagccaggggtgctggcgggcacctgtaatcccagctactcaggaggctgaagcagtagaatcgcttgaacctggaggctgaggttgcagtgagctaagatcacgccactgcactccagcctgggcaacagagtgagactccatcttaaaaaaaaaaaaaaa

SEQ ID NO: 179302 - DNA, 3780 bp, Homo sapiens
  Payload ID: 15340
  Gene Symbol: SEC24B
  Gene Name: SEC24 homolog B, COPII coat complex component
  Uniprot ID: O95487
  ENST ID: ENST00000399100
  CDS Start-End: 58-3759
ttcccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataag

SEQ ID NO: 179303 - DNA, 4066 bp, Homo sapiens
  Payload ID: 15340
  Gene Symbol: SEC24B
  Gene Name: SEC24 homolog B, COPII coat complex component
  Uniprot ID: O95487
  ENST ID: ENST00000504968
  CDS Start-End: 99-3995
ggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacgagacgggatttcaccatgttgcccaagctagtcttgaactcctggacccaagcaatctgcccgcctcggcctcccaaattgctgggagtacaggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaatatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtga

SEQ ID NO: 179304 - DNA, 4433 bp, Homo sapiens
  Payload ID: 15341
  Gene Symbol: SEC24C
  Gene Name: SEC24 homolog C, COPII coat complex component
  Uniprot ID: P53992
  ENST ID: ENST00000345254
  CDS Start-End: 83-3367
ggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 179305 - DNA, 4513 bp, Homo sapiens
  Payload ID: 15341
  Gene Symbol: SEC24C
  Gene Name: SEC24 homolog C, COPII coat complex component
  Uniprot ID: P53992
  ENST ID: ENST00000339365
  CDS Start-End: 163-3447
gggagccttgacgttaggaacgaagtctaacctggatctggagccgggagataatctgaatgctggctggggcagaaaattactaagatcctgtggaagtgtgaggattattaaactgatcactgtctgataaggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 179306 - DNA, 4668 bp, Homo sapiens
  Payload ID: 15341
  Gene Symbol: SEC24C
  Gene Name: SEC24 homolog C, COPII coat complex component
  ENST ID: ENST00000465076
  CDS Start-End: 83-3211
ggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttggtgagggcagggagtcaaggagaatatgggtgtggaagtatactttgtgaaacaattgggagccaatatagttagtgtgctagtaccctcaaatatcagggaacacttggggacaagggcagttgctgtcattcttcccaggtttgcctgtttcagatgatgcatacatgtatgctgccccaccttgactgaactcagagtgccttaccataaggataaatgaattttgtgttctagagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgt

SEQ ID NO: 179307 - DNA, 549 bp, Homo sapiens
  Payload ID: 15341
  Gene Symbol: SEC24C
  Gene Name: SEC24 homolog C, COPII coat complex component
  ENST ID: ENST00000634508
  CDS Start-End: 1-549
caggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctcaactcagtgagctgcctcctcagcagaaaaccaggcacagaatagaccccgatgccattcctagtccaattcaggtcattgaagatgacaggaacaaccggggtacagagccatttgttactggagtacggggc

SEQ ID NO: 179308 - DNA, 3424 bp, Homo sapiens
  Payload ID: 15341
  Gene Symbol: SEC24C
  Gene Name: SEC24 homolog C, COPII coat complex component
  ENST ID: ENST00000635550
  CDS Start-End: 67-609
gacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctcaactcagtgagctgcctcctcagcagaaaaccaggcacagaatagaccccgatgccattcctagtccaattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacacct

SEQ ID NO: 179309 - DNA, 4030 bp, Homo sapiens
  Payload ID: 15342
  Gene Symbol: SEC24D
  Gene Name: SEC24 homolog D, COPII coat complex component
  Uniprot ID: O94855
  ENST ID: ENST00000280551
  CDS Start-End: 240-3338
agccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 179310 - DNA, 2786 bp, Homo sapiens
  Payload ID: 15342
  Gene Symbol: SEC24D
  Gene Name: SEC24 homolog D, COPII coat complex component
  ENST ID: ENST00000419654
  CDS Start-End: 1605-2786
gcggctggtccaagcccggcgctgggggcgcgcagccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataa

SEQ ID NO: 179311 - DNA, 3806 bp, Homo sapiens
  Payload ID: 15342
  Gene Symbol: SEC24D
  Gene Name: SEC24 homolog D, COPII coat complex component
  ENST ID: ENST00000514561
  CDS Start-End: 159-362
atggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagacagtattcacaatagccaaaaggaggaagcaaccaggtgtctatggaagaagaatggataagcaaaatgtggtatatacgtacaatggaatatcattcagcctcaaaaaggaagaaaagtctgacccatgctacaacatggatgaatgttgaggatgttatgctaagtaaaataagccagccacaaaaaggataaatatggaatgattctatatgaggtcactaaagttgtttgcctgtggctctcttttctaaatattttgtaagatgcaactgaaggatcacttcctaaaagctgtttgaacaccagccagtaaagggaccaacaactaaaaaacatgttcgtagcagctgctttatgtcacagtgattattttaaacagataaagaaaacgcctgacgttctatgttaccgcaaatatgtaaaaaactagaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggcaaaaaaaaaaaaaaaa

SEQ ID NO: 179312 - DNA, 1870 bp, Homo sapiens
  Payload ID: 15342
  Gene Symbol: SEC24D
  Gene Name: SEC24 homolog D, COPII coat complex component
  ENST ID: ENST00000509818
  CDS Start-End: 161-796
atatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaaggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttttagaggaaaaaatcctgagaagggacagaggcttctcccaaagcatttggacaaagtcctccagcgagcccaccagctcctcagatgtcttcacccaagcccccagctttcttagaaaggtgaccaaaatcatacccaccatgaagagcagcaaggatcttcagtttgctgtgactctttggcctcctacccaaagtgtcggctcagggccttaaaaggcccagccacttccaggaagagaaaaacgactcagaattcttgtgtctcaacacagcagattatgttccctcagttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgt

SEQ ID NO: 179313 - DNA, 2626 bp, Homo sapiens
  Payload ID: 15342
  Gene Symbol: SEC24D
  Gene Name: SEC24 homolog D, COPII coat complex component
  ENST ID: ENST00000511481
  CDS Start-End: 144-2135
accagagccaggcccatgctgtggatcagaagcgaccataaacaagaaaatccaatctgtcttctggctttcttgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataacctt

SEQ ID NO: 179314 - DNA, 602 bp, Homo sapiens
  Payload ID: 15342
  Gene Symbol: SEC24D
  Gene Name: SEC24 homolog D, COPII coat complex component
  ENST ID: ENST00000503683
  CDS Start-End: 106-602
gtagtgcattgcacgggtacgtcatcaaatgtgcgtgtacacgtgccagattcgcctttaaacgacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcc

SEQ ID NO: 179315 - DNA, 1319 bp, Homo sapiens
  Payload ID: 15342
  Gene Symbol: SEC24D
  Gene Name: SEC24 homolog D, COPII coat complex component
  ENST ID: ENST00000506622
  CDS Start-End: 172-1089
aagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatgatcatggaaagagtggaagctcagatgttgtgaggcagaaaagagaagataggagaggaaagagtcacagtactgagatttacatcaacagaaatgctgtatatcctgttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgag

SEQ ID NO: 179316 - DNA, 3447 bp, Homo sapiens
  Payload ID: 15343
  Gene Symbol: SEC31A
  Gene Name: SEC31 homolog A, COPII coat complex component
  ENST ID: ENST00000264405
  CDS Start-End: 486-3395
atgccaggtatcgtgctgctgttacaaagaacttgatttgtttattttctgaacatgtcggtgatgttttcgtgaccagaaatacaccataggacacaggaacttttttttttagatggagttttgctctgtcacttaggctggagtgcagtggcaagatcttggctcactgcaacctctgcctcccaggttcaaacgattctcctgcctcagcctcctgagtagctgggattacaggcgcaagccaccatgccaggaaatttttatagttttataaaaattttatagctgggattacatgcatgcgccaccacgcccagctaattttcatagttttagtagagatggggttttaccatgttggccaggctggtctcaaacttctgacctcaagtgatctgcccacctttgcctcccaaagtgctgggaatacaggcatgggccaccgtaggaacttaatgtttatgtcagttatcagttagtctatggtaaaattggttttgttatccattgttttgcttaaagtcacagttcctaaattaagtaacgacttactgcagttagatttcatgcccatccatagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgtt

SEQ ID NO: 179317 - DNA, 3909 bp, Homo sapiens
  Payload ID: 15343
  Gene Symbol: SEC31A
  Gene Name: SEC31 homolog A, COPII coat complex component
  Uniprot ID: O94979
  ENST ID: ENST00000311785
  CDS Start-End: 177-3497
agatgtcgctcccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 179318 - DNA, 4012 bp, Homo sapiens
  Payload ID: 15343
  Gene Symbol: SEC31A
  Gene Name: SEC31 homolog A, COPII coat complex component
  Uniprot ID: O94979
  ENST ID: ENST00000348405
  CDS Start-End: 54-3599
gacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 179319 - DNA, 4104 bp, Homo sapiens
  Payload ID: 15343
  Gene Symbol: SEC31A
  Gene Name: SEC31 homolog A, COPII coat complex component
  Uniprot ID: O94979
  ENST ID: ENST00000355196
  CDS Start-End: 379-4041
gcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaa

SEQ ID NO: 179320 - DNA, 4259 bp, Homo sapiens
  Payload ID: 15343
  Gene Symbol: SEC31A
  Gene Name: SEC31 homolog A, COPII coat complex component
  Uniprot ID: O94979
  ENST ID: ENST00000395310
  CDS Start-End: 184-3846
cggggaaagatgtcgctcccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 179321 - DNA, 4255 bp, Homo sapiens
  Payload ID: 15343
  Gene Symbol: SEC31A
  Gene Name: SEC31 homolog A, COPII coat complex component
  Uniprot ID: O94979
  ENST ID: ENST00000448323
  CDS Start-End: 181-3843
cggggaaagatgtcgctcccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 179322 - DNA, 4042 bp, Homo sapiens
  Payload ID: 15343
  Gene Symbol: SEC31A
  Gene Name: SEC31 homolog A, COPII coat complex component
  Uniprot ID: O94979
  ENST ID: ENST00000443462
  CDS Start-End: 28-3630
ctggccggggaggaggggcggcggcgaatgctgggagagtccgacgagcgctgcactaacgcaggatccggctgccgaaggtcctcgccaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 179323 - DNA, 546 bp, Homo sapiens
  Payload ID: 15343
  Gene Symbol: SEC31A
  Gene Name: SEC31 homolog A, COPII coat complex component
  ENST ID: ENST00000507816
  CDS Start-End: 123-401
acgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcagactaatctggtagcttctggtgctaatgaatctgaaatctacatatgggatctaaataattttgcaaccccaatgacaccaggagccaaaacacagccgccagaagatatcagctgcattgcatggaacagacaagttcagcatatttta

SEQ ID NO: 179324 - DNA, 3610 bp, Homo sapiens
  Payload ID: 15343
  Gene Symbol: SEC31A
  Gene Name: SEC31 homolog A, COPII coat complex component
  Uniprot ID: O94979
  ENST ID: ENST00000500777
  CDS Start-End: 5-3208
caggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagt

SEQ ID NO: 179325 - DNA, 4159 bp, Homo sapiens
  Payload ID: 15343
  Gene Symbol: SEC31A
  Gene Name: SEC31 homolog A, COPII coat complex component
  ENST ID: ENST00000505472
  CDS Start-End: 2-3757
gatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagt

SEQ ID NO: 179326 - DNA, 857 bp, Homo sapiens
  Payload ID: 15343
  Gene Symbol: SEC31A
  Gene Name: SEC31 homolog A, COPII coat complex component
  ENST ID: ENST00000510167
  CDS Start-End: 1-857
tttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaaggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgt

SEQ ID NO: 179327 - DNA, 1564 bp, Homo sapiens
  Payload ID: 15343
  Gene Symbol: SEC31A
  Gene Name: SEC31 homolog A, COPII coat complex component
  ENST ID: ENST00000503937
  CDS Start-End: 1-1151
caaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 179328 - DNA, 553 bp, Homo sapiens
  Payload ID: 15343
  Gene Symbol: SEC31A
  Gene Name: SEC31 homolog A, COPII coat complex component
  ENST ID: ENST00000503210
  CDS Start-End: 310-553
aataagaccatccaattaatggaggactcctttcgcgtaactctccttaaagcggtaggcggtgcgagaaccggctattcagagctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattcca

SEQ ID NO: 179329 - DNA, 587 bp, Homo sapiens
  Payload ID: 15343
  Gene Symbol: SEC31A
  Gene Name: SEC31 homolog A, COPII coat complex component
  ENST ID: ENST00000507340
  CDS Start-End: 158-364
gttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaat

SEQ ID NO: 179330 - DNA, 710 bp, Homo sapiens
  Payload ID: 15343
  Gene Symbol: SEC31A
  Gene Name: SEC31 homolog A, COPII coat complex component
  ENST ID: ENST00000512664
  CDS Start-End: 1-710
ggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcga

SEQ ID NO: 179331 - DNA, 3596 bp, Homo sapiens
  Payload ID: 15343
  Gene Symbol: SEC31A
  Gene Name: SEC31 homolog A, COPII coat complex component
  Uniprot ID: O94979
  ENST ID: ENST00000505984
  CDS Start-End: 66-3566
ctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgc

SEQ ID NO: 179332 - DNA, 3801 bp, Homo sapiens
  Payload ID: 15343
  Gene Symbol: SEC31A
  Gene Name: SEC31 homolog A, COPII coat complex component
  Uniprot ID: O94979
  ENST ID: ENST00000508502
  CDS Start-End: 121-3738
gttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaa

SEQ ID NO: 179333 - DNA, 706 bp, Homo sapiens
  Payload ID: 15343
  Gene Symbol: SEC31A
  Gene Name: SEC31 homolog A, COPII coat complex component
  ENST ID: ENST00000503058
  CDS Start-End: 1-706
acgcaggatccggctgccgaaggtcctcgccagcaggatgaagttaaaggaagtagatcgtacagccatgcaggcatggagccctgcccagaatcaccccatttacctagcaacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccaggtatcgtgctg

SEQ ID NO: 179334 - DNA, 541 bp, Homo sapiens
  Payload ID: 15343
  Gene Symbol: SEC31A
  Gene Name: SEC31 homolog A, COPII coat complex component
  ENST ID: ENST00000506495
  CDS Start-End: 462-541
gcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaagcaggatgaagttaaaggaagtagatcgtacagccatgcaggcatggagccctgcccagaatcaccccatttacctagcaacagg

SEQ ID NO: 179335 - DNA, 569 bp, Homo sapiens
  Payload ID: 15343
  Gene Symbol: SEC31A
  Gene Name: SEC31 homolog A, COPII coat complex component
  ENST ID: ENST00000505434
  CDS Start-End: 372-569
gaaggtcctcgccaggtgcgtccgcccgttgctttttgtcctcttcgccggtccttaagctttgaggtagagcccaggccaaaactgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagaggtgcggtccccgaggcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttct

SEQ ID NO: 179336 - DNA, 657 bp, Homo sapiens
  Payload ID: 15343
  Gene Symbol: SEC31A
  Gene Name: SEC31 homolog A, COPII coat complex component
  ENST ID: ENST00000511338
  CDS Start-End: 1-657
ccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatt

SEQ ID NO: 179337 - DNA, 847 bp, Homo sapiens
  Payload ID: 15343
  Gene Symbol: SEC31A
  Gene Name: SEC31 homolog A, COPII coat complex component
  ENST ID: ENST00000514326
  CDS Start-End: 350-847
ctcgccaggtgcgtccgcccgttgctttttgtcctcttcgccggtccttaagctttgaggtagagcccaggccaaaactgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacag

SEQ ID NO: 179338 - DNA, 3397 bp, Homo sapiens
  Payload ID: 15343
  Gene Symbol: SEC31A
  Gene Name: SEC31 homolog A, COPII coat complex component
  ENST ID: ENST00000508479
  CDS Start-End: 71-2704
gaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgttcagagtagttgactcctgttcctcagccattactaagacttgttaaagataatcaagtgtcccatgattttggtataaagaaacagaattttagaaattattttttacatattctttttcttcaggcaagatgacacaaattatttttggaaaaatggtttcaaggggcatttgttattactgtttttccattttatttatttatttaatagactttgtattttagagcagtcttaggttcagaacaaaattgagcagaaagtacagagtgcccccactattgacatcctacgccacagtggtgtatttgttacaatcgatgaacctacatcaatgtctcattatcacccaaagtccacagtttacactctcagtgttgtacattctgtggattttaacaaatgtgtaatgacatgtatctattagtggcatttttaaaagaaaataattatacctggaaagtgaaatattgccactatttgaaaatttaaatgc

SEQ ID NO: 179339 - DNA, 1329 bp, Homo sapiens
  Payload ID: 15343
  Gene Symbol: SEC31A
  Gene Name: SEC31 homolog A, COPII coat complex component
  ENST ID: ENST00000507828
  CDS Start-End: 1-1329
ctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtgcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttca

SEQ ID NO: 179340 - DNA, 3861 bp, Homo sapiens
  Payload ID: 15343
  Gene Symbol: SEC31A
  Gene Name: SEC31 homolog A, COPII coat complex component
  Uniprot ID: O94979
  ENST ID: ENST00000509142
  CDS Start-End: 129-3449
gcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 179341 - DNA, 3687 bp, Homo sapiens
  Payload ID: 15343
  Gene Symbol: SEC31A
  Gene Name: SEC31 homolog A, COPII coat complex component
  Uniprot ID: O94979
  ENST ID: ENST00000513858
  CDS Start-End: 71-3274
gaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 179342 - DNA, 597 bp, Homo sapiens
  Payload ID: 15343
  Gene Symbol: SEC31A
  Gene Name: SEC31 homolog A, COPII coat complex component
  ENST ID: ENST00000515062
  CDS Start-End: 1-544
tcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctctttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgtta

SEQ ID NO: 179343 - DNA, 822 bp, Homo sapiens
  Payload ID: 15343
  Gene Symbol: SEC31A
  Gene Name: SEC31 homolog A, COPII coat complex component
  ENST ID: ENST00000513323
  CDS Start-End: 329-822
ctgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagaggtgcggtccccgagggtgaggagaggaaaaaaaatctcaggattactttggctttgcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaac

SEQ ID NO: 179344 - DNA, 551 bp, Homo sapiens
  Payload ID: 15343
  Gene Symbol: SEC31A
  Gene Name: SEC31 homolog A, COPII coat complex component
  ENST ID: ENST00000507676
  CDS Start-End: 357-551
gcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctct

SEQ ID NO: 179345 - DNA, 458 bp, Homo sapiens
  Payload ID: 15343
  Gene Symbol: SEC31A
  Gene Name: SEC31 homolog A, COPII coat complex component
  ENST ID: ENST00000507051
  CDS Start-End: 424-458
gcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaagcaggatgaagttaaaggaagtagatcgtacagccatgca

SEQ ID NO: 179346 - DNA, 4612 bp, Homo sapiens
  Payload ID: 15344
  Gene Symbol: SEC31B
  Gene Name: SEC31 homolog B, COPII coat complex component
  Uniprot ID: Q9NQW1
  ENST ID: ENST00000370345
  CDS Start-End: 99-3638
gaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggtttcc

SEQ ID NO: 179347 - DNA, 3916 bp, Homo sapiens
  Payload ID: 15344
  Gene Symbol: SEC31B
  Gene Name: SEC31 homolog B, COPII coat complex component
  ENST ID: ENST00000482456
  CDS Start-End: 146-403
agaggagcggctccggccgccgcgcctgacccttgtccggggtcttccgcacagatgctccctggatctggctgttaagtttgctggtttctattttcagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagc

SEQ ID NO: 179348 - DNA, 4396 bp, Homo sapiens
  Payload ID: 15344
  Gene Symbol: SEC31B
  Gene Name: SEC31 homolog B, COPII coat complex component
  ENST ID: ENST00000469546
  CDS Start-End: 44-1093
ggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttcagggaccgtgggacccctttgctgggacagttatttcaagagtatgactcttatctttctctcttctatagatccattttgtgccacactccattgtagactttgaatgtagtagtctttccaagagcctacttgcatgggagtcccaccctcgctaccactcacttccccatcccctggaatatgggagtctgacctttctaggtcaaattgggtgtctcaaggattcctcccaaaatggagtttgtaggtggagttcctgactaaactgccactttaggatggcgatgcaggtgtcttttccccccagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctggacctcaagattcctggaaagaagccccagcccccaggggaaacctccagaggaacaagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgc

SEQ ID NO: 179349 - DNA, 799 bp, Homo sapiens
  Payload ID: 15344
  Gene Symbol: SEC31B
  Gene Name: SEC31 homolog B, COPII coat complex component
  ENST ID: ENST00000480905
  CDS Start-End: 129-386
agcgcccggctccgcgcgagagccctgccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaac

SEQ ID NO: 179350 - DNA, 5087 bp, Homo sapiens
  Payload ID: 15344
  Gene Symbol: SEC31B
  Gene Name: SEC31 homolog B, COPII coat complex component
  ENST ID: ENST00000479697
  CDS Start-End: 124-381
ccggctccgcgcgagagccctgccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttcagggaccgtgggacccctttgctgggacagttatttcaagagtatgactcttatctttctctcttctatagatccattttgtgccacactccattgtagactttgaatgtagtagtctttccaagagcctacttgcatgggagtcccaccctcgctaccactcacttccccatcccctggaatatgggagtctgacctttctaggtcaaattgggtgtctcaaggattcctcccaaaatggagtttgtaggtggagttcctgactaaactgccactttaggatggcgatgcaggtgtcttttccccccagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggaggagtactatacctatcaaaggaaatgagcaagtgagagatctgaaggaagaaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 179351 - DNA, 4849 bp, Homo sapiens
  Payload ID: 15344
  Gene Symbol: SEC31B
  Gene Name: SEC31 homolog B, COPII coat complex component
  Uniprot ID: Q9NQW1
  ENST ID: ENST00000462434
  CDS Start-End: 66-1112
gccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttcagggaccgtgggacccctttgctgggacagttatttcaagagtatgactcttatctttctctcttctatagatccattttgtgccacactccattgtagactttgaatgtagtagtctttccaagagcctacttgcatgggagtcccaccctcgctaccactcacttccccatcccctggaatatgggagtctgacctttctaggtcaaattgggtgtctcaaggattcctcccaaaatggagtttgtaggtggagttcctgactaaactgccactttaggatggcgatgcaggtgtcttttccccccagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttg

SEQ ID NO: 179352 - DNA, 3635 bp, Homo sapiens
  Payload ID: 15345
  Gene Symbol: SEC61A1
  Gene Name: Sec61 translocon alpha 1 subunit
  Uniprot ID: P61619
  ENST ID: ENST00000243253
  CDS Start-End: 185-1615
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggt

SEQ ID NO: 179353 - DNA, 3238 bp, Homo sapiens
  Payload ID: 15345
  Gene Symbol: SEC61A1
  Gene Name: Sec61 translocon alpha 1 subunit
  Uniprot ID: P61619
  ENST ID: ENST00000424880
  CDS Start-End: 153-1223
agaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaagtatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttac

SEQ ID NO: 179354 - DNA, 1871 bp, Homo sapiens
  Payload ID: 15345
  Gene Symbol: SEC61A1
  Gene Name: Sec61 translocon alpha 1 subunit
  ENST ID: ENST00000464451
  CDS Start-End: 246-1694
aatcacaccgccatgctttgcccacaacagtctcctcaacctgttccctcattccttctcgccagaatctatcaaggctcggcacaaaggtactctcccaggaggccttcctgaattcttctgtgaggcagactacttcccgagctgccccggcccttctccggccaagtctctccagaaactcatcccattcgttctcagatggaaggggacccacacccacgacaagcctccgggtttgcttaatgactcagacagcgagggtgctcgtcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttat

SEQ ID NO: 179355 - DNA, 521 bp, Homo sapiens
  Payload ID: 15345
  Gene Symbol: SEC61A1
  Gene Name: Sec61 translocon alpha 1 subunit
  ENST ID: ENST00000481210
  CDS Start-End: 219-521
gggctagcactgacgtgtctctcggcggagctgctgtgcagtggaacgcgctgggccgcgggcagcgtcgcctcacgcggagcagagctgagctgaagcgggacccggagcccgagcagccgccgccatggcaaattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcag

SEQ ID NO: 179356 - DNA, 1893 bp, Homo sapiens
  Payload ID: 15346
  Gene Symbol: SEC61A2
  Gene Name: Sec61 translocon alpha 2 subunit
  Uniprot ID: Q9H9S3
  ENST ID: ENST00000298428
  CDS Start-End: 90-1520
gggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgcc

SEQ ID NO: 179357 - DNA, 2030 bp, Homo sapiens
  Payload ID: 15346
  Gene Symbol: SEC61A2
  Gene Name: Sec61 translocon alpha 2 subunit
  Uniprot ID: Q9H9S3
  ENST ID: ENST00000304267
  CDS Start-End: 88-1401
gagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaatagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgat

SEQ ID NO: 179358 - DNA, 600 bp, Homo sapiens
  Payload ID: 15346
  Gene Symbol: SEC61A2
  Gene Name: Sec61 translocon alpha 2 subunit
  ENST ID: ENST00000379017
  CDS Start-End: 56-562
gagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggcgttactaacattgaaaatatgtggatacactgaagagctatgattggatcagtgtgtttcacccagaaacataggttttga

SEQ ID NO: 179359 - DNA, 2252 bp, Homo sapiens
  Payload ID: 15346
  Gene Symbol: SEC61A2
  Gene Name: Sec61 translocon alpha 2 subunit
  ENST ID: ENST00000379020
  CDS Start-End: 62-1294
ggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgttt

SEQ ID NO: 179360 - DNA, 2462 bp, Homo sapiens
  Payload ID: 15346
  Gene Symbol: SEC61A2
  Gene Name: Sec61 translocon alpha 2 subunit
  Uniprot ID: Q9H9S3
  ENST ID: ENST00000379033
  CDS Start-End: 148-1512
aagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatatt

SEQ ID NO: 179361 - DNA, 707 bp, Homo sapiens
  Payload ID: 15346
  Gene Symbol: SEC61A2
  Gene Name: Sec61 translocon alpha 2 subunit
  ENST ID: ENST00000379051
  CDS Start-End: 152-631
ggcgaagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggatcaacacagcccttagacttatcctttgatggcagtgtacatttccatcttgctattataccagaattcatctgactttttacttccttgga

SEQ ID NO: 179362 - DNA, 434 bp, Homo sapiens
  Payload ID: 15346
  Gene Symbol: SEC61A2
  Gene Name: Sec61 translocon alpha 2 subunit
  ENST ID: ENST00000418772
  CDS Start-End: 1-434
atcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagggatttcgcgttgatctgcccattaagtcggcccgttaccgaggacagtacagcagctaccccatcaaactcttctacacctccaacatccccatcatcctccagtcggccctggtgtccaacctgtatgttattt

SEQ ID NO: 179363 - DNA, 314 bp, Homo sapiens
  Payload ID: 15346
  Gene Symbol: SEC61A2
  Gene Name: Sec61 translocon alpha 2 subunit
  ENST ID: ENST00000457034
  CDS Start-End: 1-284
agtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgag

SEQ ID NO: 179364 - DNA, 778 bp, Homo sapiens
  Payload ID: 15346
  Gene Symbol: SEC61A2
  Gene Name: Sec61 translocon alpha 2 subunit
  ENST ID: ENST00000419021
  CDS Start-End: 1-685
tggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccc

SEQ ID NO: 179365 - DNA, 691 bp, Homo sapiens
  Payload ID: 15346
  Gene Symbol: SEC61A2
  Gene Name: Sec61 translocon alpha 2 subunit
  ENST ID: ENST00000441368
  CDS Start-End: 123-691
gcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaacgtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcag

SEQ ID NO: 179366 - DNA, 850 bp, Homo sapiens
  Payload ID: 15346
  Gene Symbol: SEC61A2
  Gene Name: Sec61 translocon alpha 2 subunit
  ENST ID: ENST00000472221
  CDS Start-End: 87-575
agccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccag

SEQ ID NO: 179367 - DNA, 2183 bp, Homo sapiens
  Payload ID: 15346
  Gene Symbol: SEC61A2
  Gene Name: Sec61 translocon alpha 2 subunit
  ENST ID: ENST00000475268
  CDS Start-End: 95-1351
gcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaatagtgctagagcgtaggaatagaccctggcgtccactgtgagatgttcttcagctaccagagctgtggaaagcaaagaaaacaacttagatcatgccgttaaggaaggacaaaacatcttattcaatcagtgtttgcgcagcagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgatgacaa

SEQ ID NO: 179368 - DNA, 545 bp, Homo sapiens
  Payload ID: 15347
  Gene Symbol: SEC61B
  Gene Name: Sec61 translocon beta subunit
  Uniprot ID: P60468
  ENST ID: ENST00000223641
  CDS Start-End: 64-354
ctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttata

SEQ ID NO: 179369 - DNA, 587 bp, Homo sapiens
  Payload ID: 15347
  Gene Symbol: SEC61B
  Gene Name: Sec61 translocon beta subunit
  ENST ID: ENST00000498603
  CDS Start-End: 268-396
atcttgtctgaccccggttatatttttccttcggtagggattggactttctgaaggacgttgtgatccaaaggaaggaggccggaggtctctacttcccatacagcagcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttata

SEQ ID NO: 179370 - DNA, 462 bp, Homo sapiens
  Payload ID: 15348
  Gene Symbol: SEC61G
  Gene Name: Sec61 translocon gamma subunit
  Uniprot ID: P60059
  ENST ID: ENST00000352861
  CDS Start-End: 96-302
ggcagaaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatg

SEQ ID NO: 179371 - DNA, 459 bp, Homo sapiens
  Payload ID: 15348
  Gene Symbol: SEC61G
  Gene Name: Sec61 translocon gamma subunit
  Uniprot ID: P60059
  ENST ID: ENST00000395535
  CDS Start-End: 92-298
ggcagaaacccggattccggttccggtgggcctccatcagcaagctccagtgctacgtgtccctggcattttaggtgtcggttgggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatga

SEQ ID NO: 179372 - DNA, 732 bp, Homo sapiens
  Payload ID: 15348
  Gene Symbol: SEC61G
  Gene Name: Sec61 translocon gamma subunit
  Uniprot ID: P60059
  ENST ID: ENST00000415949
  CDS Start-End: 368-574
attgctaaaaggaaacatggccgggcgcggtggctcacgtctgtaatcccagcactttgggaggccgaggcgggtggatcgcgaggtcaggagttcaagaccagcctggccaatatggtgaaaccccgtctctactgacggtttcagccatccggcggggggttcctggaatgcatccttgtgggaagcgtggccgggcgcacgtcgcgctgcgcttgcgcactgaggtttcgcgtaaggaaccaataggacggaggagtgggcgggctgttggcagaaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 179373 - DNA, 512 bp, Homo sapiens
  Payload ID: 15348
  Gene Symbol: SEC61G
  Gene Name: Sec61 translocon gamma subunit
  Uniprot ID: P60059
  ENST ID: ENST00000450622
  CDS Start-End: 152-358
ggcattttaggtgtcggttgggtaggtgagtttcttcccaccggtcggtacgggcgaacggggcggccacacctttgcgactcttgggggcagcgggcgtgggcgagccggcgtgtctccccgggcggccgtcgcggggcgggcggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaag

SEQ ID NO: 179374 - DNA, 6568 bp, Homo sapiens
  Payload ID: 15349
  Gene Symbol: SEC62
  Gene Name: SEC62 homolog, preprotein translocation factor
  Uniprot ID: Q99442
  ENST ID: ENST00000337002
  CDS Start-End: 59-1258
aggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcggcctcccaaagtgctgggattacaggcatgagccaccatgcctggccagaataatgtttttaaatgcagaaaaggaaatgcatggggttacaagggaaacgaattacactgaagtgtaagctaccaaataatttatgatgtggtagttataggtgtgcatttaatagccagatctacgagtggatgtaataactgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagcaa

SEQ ID NO: 179375 - DNA, 785 bp, Homo sapiens
  Payload ID: 15349
  Gene Symbol: SEC62
  Gene Name: SEC62 homolog, preprotein translocation factor
  ENST ID: ENST00000469515
  CDS Start-End: 9-314
cggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttg

SEQ ID NO: 179376 - DNA, 641 bp, Homo sapiens
  Payload ID: 15349
  Gene Symbol: SEC62
  Gene Name: SEC62 homolog, preprotein translocation factor
  ENST ID: ENST00000460513
  CDS Start-End: 23-280
ggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgag

SEQ ID NO: 179377 - DNA, 508 bp, Homo sapiens
  Payload ID: 15349
  Gene Symbol: SEC62
  Gene Name: SEC62 homolog, preprotein translocation factor
  ENST ID: ENST00000487736
  CDS Start-End: 10-153
gcggccaacatggcggaacgcaggagacacaagaagcggatccagtataatttcagattctcgtgtcccatcgaagtttctagcaagaggactgttgtcacatttccttcttggactcattactggtcactgaaaaccagaagaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaag

SEQ ID NO: 179378 - DNA, 1430 bp, Homo sapiens
  Payload ID: 15349
  Gene Symbol: SEC62
  Gene Name: SEC62 homolog, preprotein translocation factor
  Uniprot ID: Q99442
  ENST ID: ENST00000480708
  CDS Start-End: 16-1215
ggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgtta

SEQ ID NO: 179379 - DNA, 6411 bp, Homo sapiens
  Payload ID: 15350
  Gene Symbol: SEC63
  Gene Name: SEC63 homolog, protein translocation regulator
  Uniprot ID: Q9UGP8
  ENST ID: ENST00000369002
  CDS Start-End: 181-2463
cggcggcggcagcggcagaggtggcggcggcgtgtccgtgagagtggcgtgggggcggggaggagaggcggcggcggcagtgtccaagctacgccactcgggccggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaactcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactcttgaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgaatggtttttttggttctaaatttaagatgtaatatttcctataaaagggtgaaagcagtttctttctctataacctcaatcaccagtttagtgagagcctttcttggcaggcaggaggcagtgtcactgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacgaaggcaaggaaactgagcagacaagacagaacaatgtgtagaatgcatatttcctagttttcttgaaagatttcaagaaaagttgtttttttttttctagtggctactttgccttaaagaggctttataagttcattcacacagctggcttctctggttttaagattctggagaggatgataacctagtaacaccacagtgcttaaaaaaaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcgtggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttagtctatctactgtaggcagaagaattatttctttaggggctagctgtttattttgctggcctttttttctctctttctctttttcttcttaagacggagtctcgctctgtcctccaggctggaggagtgcagtggcacgatctcagctcactgcaacctccgcctcccagcttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagccactgcgcccagcctgttgggtttttttggaaaaaaaacaaaaacaacaaatcatcatcctttcctttaaaatgtttttttttttttaagaaacaattttcccacaaacggtctgatttaactccatgaaatcctctatttagactgccttaaagtgaaataactgttggtgaaccataacattttgccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaa

SEQ ID NO: 179380 - DNA, 647 bp, Homo sapiens
  Payload ID: 15350
  Gene Symbol: SEC63
  Gene Name: SEC63 homolog, protein translocation regulator
  ENST ID: ENST00000429168
  CDS Start-End: 164-647
tttcatttgttcactcactgtgggggttggaagcaatgccgttattcctcttagcaaaaataggcttttttctatttccttttcttcggagtttcctgtttgtgacggaaaaagtgcaaagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaactcaattctggttttacttgtatatggattggcatttatggttatccttccagttgttgtgggctcttggtggtatcgctcaatacgct

SEQ ID NO: 179381 - DNA, 583 bp, Homo sapiens
  Payload ID: 15350
  Gene Symbol: SEC63
  Gene Name: SEC63 homolog, protein translocation regulator
  ENST ID: ENST00000446496
  CDS Start-End: 103-345
agtgtccaagctacgccactcgggccggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgcggggagagtctcatttacccaggctggtcttgaacttgcttcaagtcatcctcccgcttcagccccccgagtagctggccttacagacttgagccactgtgtcaggatggatttttgaaatttgaaagtcatattttcatgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcct

SEQ ID NO: 179382 - DNA, 5257 bp, Homo sapiens
  Payload ID: 15351
  Gene Symbol: SCRN1
  Gene Name: secernin 1
  Uniprot ID: Q12765
  ENST ID: ENST00000242059
  CDS Start-End: 159-1403
tctgggtagggggaagcgcccggcggccgcctccgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaacatcca

SEQ ID NO: 179383 - DNA, 1732 bp, Homo sapiens
  Payload ID: 15351
  Gene Symbol: SCRN1
  Gene Name: secernin 1
  Uniprot ID: Q12765
  ENST ID: ENST00000409497
  CDS Start-End: 205-1449
attaaacaatatctggtctcggtggctctgtcattccactgcaggcgtcccaccttcatttgccagctgggatctcttaatgagctagctgtgcacagttcaatagtaaaacccttttagctggtgaaatatgtttgaagaactcactgttggagtgttccatgtgaggcctgcttccactcttgctggcattctcttttcaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggc

SEQ ID NO: 179384 - DNA, 535 bp, Homo sapiens
  Payload ID: 15351
  Gene Symbol: SCRN1
  Gene Name: secernin 1
  ENST ID: ENST00000409570
  CDS Start-End: 91-513
taatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggaacgggcagggtgagcttgacatacctgtgagaaggtcatgggctcccagggaaagattttcctataaaactaggaattgaattcaggagcatctaattccca

SEQ ID NO: 179385 - DNA, 1454 bp, Homo sapiens
  Payload ID: 15351
  Gene Symbol: SCRN1
  Gene Name: secernin 1
  Uniprot ID: Q12765
  ENST ID: ENST00000434476
  CDS Start-End: 50-1354
ctctaggccacaatgtccaagtacctgggacagggtctggcttaccaacatggtacaggacggcacttttaaaaccagggactcgacttggacgtgcgagtcaacaaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaa

SEQ ID NO: 179386 - DNA, 560 bp, Homo sapiens
  Payload ID: 15351
  Gene Symbol: SCRN1
  Gene Name: secernin 1
  ENST ID: ENST00000438497
  CDS Start-End: 137-560
atattagataatggagaagcaaatggcaaggatggttaccttggctaccaagataaagaaccttgaaaagggaagaagatgaaatcagcttcggatatcaggcaggcagctgggtctgtgggtcagaggcttaaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtggga

SEQ ID NO: 179387 - DNA, 5275 bp, Homo sapiens
  Payload ID: 15351
  Gene Symbol: SCRN1
  Gene Name: secernin 1
  Uniprot ID: Q12765
  ENST ID: ENST00000426154
  CDS Start-End: 178-1422
aaacgtcgggaagaggcgccaaaaggatgctgggcctggctccttgaagcccgggttttcccttttgagagccacaaccaagaaataaaaatctagcaaagagggggccactttctgcggcgagatacgccctctcggccgctcctccagctcccaggccccctccctactcgacggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaacatcc

SEQ ID NO: 179388 - DNA, 1001 bp, Homo sapiens
  Payload ID: 15351
  Gene Symbol: SCRN1
  Gene Name: secernin 1
  ENST ID: ENST00000421434
  CDS Start-End: 265-1001
gacttggacgtgcgagtcaacaaggtacaggacacatttctctccggggaaatcttgtgtgggcgccgaggcccggacgtagcaaccaaacgtcgggaagaggcgccaaaaggatgctgggcctggctccttgaagcccgggttttcccttttgagagccacaaccaagaaataaaaatctagcaaagagggggccactttctgcggcgagatacgccctctcggccgctcctccagctcccaggccccctccctactcgacggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaaga

SEQ ID NO: 179389 - DNA, 1552 bp, Homo sapiens
  Payload ID: 15351
  Gene Symbol: SCRN1
  Gene Name: secernin 1
  Uniprot ID: Q12765
  ENST ID: ENST00000425819
  CDS Start-End: 117-1157
acccgcaccctcggcggccgcagcctcagcaccgcagagcggagagcggagcccggagcccgccgccccagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtcttt

SEQ ID NO: 179390 - DNA, 423 bp, Homo sapiens
  Payload ID: 15351
  Gene Symbol: SCRN1
  Gene Name: secernin 1
  ENST ID: ENST00000631335
  CDS Start-End: 1-423
atggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggaacgggcagggtgagcttgacatacctgtgagaaggtcatgggctcccagggaaagattttcctataaaactaggaattga

SEQ ID NO: 179391 - DNA, 1548 bp, Homo sapiens
  Payload ID: 15352
  Gene Symbol: SCRN2
  Gene Name: secernin 2
  Uniprot ID: Q96FV2
  ENST ID: ENST00000290216
  CDS Start-End: 127-1404
ccggctccgaccccgaggccgaaggccttccaggtcacctgagagtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgct

SEQ ID NO: 179392 - DNA, 1779 bp, Homo sapiens
  Payload ID: 15352
  Gene Symbol: SCRN2
  Gene Name: secernin 2
  Uniprot ID: Q96FV2
  ENST ID: ENST00000407215
  CDS Start-End: 83-1219
gtctccgcccaatggggcggccctggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttggggaatgtcggggggtatctcctttctcctgcttgtgtgaggtggtacacagtccccccttcacctggcgggaagcctgtcccggacagactcatctcagctttcccttggggcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttc

SEQ ID NO: 179393 - DNA, 952 bp, Homo sapiens
  Payload ID: 15352
  Gene Symbol: SCRN2
  Gene Name: secernin 2
  ENST ID: ENST00000579856
  CDS Start-End: 59-352
ggccagaagcggaggaggtggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctcta

SEQ ID NO: 179394 - DNA, 1624 bp, Homo sapiens
  Payload ID: 15352
  Gene Symbol: SCRN2
  Gene Name: secernin 2
  ENST ID: ENST00000582459
  CDS Start-End: 8-391
tccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcc

SEQ ID NO: 179395 - DNA, 1745 bp, Homo sapiens
  Payload ID: 15352
  Gene Symbol: SCRN2
  Gene Name: secernin 2
  ENST ID: ENST00000584123
  CDS Start-End: 307-1608
gttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataa

SEQ ID NO: 179396 - DNA, 932 bp, Homo sapiens
  Payload ID: 15352
  Gene Symbol: SCRN2
  Gene Name: secernin 2
  ENST ID: ENST00000584567
  CDS Start-End: 1-808
cacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcc

SEQ ID NO: 179397 - DNA, 624 bp, Homo sapiens
  Payload ID: 15352
  Gene Symbol: SCRN2
  Gene Name: secernin 2
  ENST ID: ENST00000578323
  CDS Start-End: 84-624
ctggccagaagcggaggaggtggcacccgggaccgagctggggtcttggaggaagagagggtgaggggaatacagtactggggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctg

SEQ ID NO: 179398 - DNA, 683 bp, Homo sapiens
  Payload ID: 15352
  Gene Symbol: SCRN2
  Gene Name: secernin 2
  ENST ID: ENST00000583090
  CDS Start-End: 262-555
ggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatct

SEQ ID NO: 179399 - DNA, 1477 bp, Homo sapiens
  Payload ID: 15352
  Gene Symbol: SCRN2
  Gene Name: secernin 2
  ENST ID: ENST00000581645
  CDS Start-End: 41-856
tggcacccgggaccgagctggggtcttggaggaagagaggatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccaggagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaagcttccccctctactccttggcagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaata

SEQ ID NO: 179400 - DNA, 3037 bp, Homo sapiens
  Payload ID: 15353
  Gene Symbol: SCRN3
  Gene Name: secernin 3
  Uniprot ID: Q0VDG4
  ENST ID: ENST00000272732
  CDS Start-End: 83-1357
ttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcc

SEQ ID NO: 179401 - DNA, 1788 bp, Homo sapiens
  Payload ID: 15353
  Gene Symbol: SCRN3
  Gene Name: secernin 3
  Uniprot ID: Q0VDG4
  ENST ID: ENST00000409673
  CDS Start-End: 13-1266
ttccggcaactgatgcctccactggccactcctccctccgtccacctgtcacttcgggtagctgggaggccagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgc

SEQ ID NO: 179402 - DNA, 582 bp, Homo sapiens
  Payload ID: 15353
  Gene Symbol: SCRN3
  Gene Name: secernin 3
  ENST ID: ENST00000435964
  CDS Start-End: 552-582
aactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacggtactggcgccgaaagacgttcaataaatacttattgaatgacgaatacgcgttaggagttgttaaaaaaaatggaacctttttcctgtgacactttcgtgg

SEQ ID NO: 179403 - DNA, 804 bp, Homo sapiens
  Payload ID: 15353
  Gene Symbol: SCRN3
  Gene Name: secernin 3
  ENST ID: ENST00000458563
  CDS Start-End: 156-804
cagcttccggcaactgatgcctccactggccactcctccctccgtccacctgtcacttcgggtagctgggaggccagcaaaataaggacctttaggtgttctattataagtgaagatctaagattttccaagttacaactgaagagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaa

SEQ ID NO: 179404 - DNA, 1141 bp, Homo sapiens
  Payload ID: 15353
  Gene Symbol: SCRN3
  Gene Name: secernin 3
  ENST ID: ENST00000437944
  CDS Start-End: 98-451
atcaaaggtgacagcttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatca

SEQ ID NO: 179405 - DNA, 548 bp, Homo sapiens
  Payload ID: 15353
  Gene Symbol: SCRN3
  Gene Name: secernin 3
  ENST ID: ENST00000424069
  CDS Start-End: 208-548
gtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcag

SEQ ID NO: 179406 - DNA, 839 bp, Homo sapiens
  Payload ID: 15353
  Gene Symbol: SCRN3
  Gene Name: secernin 3
  ENST ID: ENST00000427038
  CDS Start-End: 434-839
gggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacgttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaa

SEQ ID NO: 179407 - DNA, 718 bp, Homo sapiens
  Payload ID: 15353
  Gene Symbol: SCRN3
  Gene Name: secernin 3
  ENST ID: ENST00000548031
  CDS Start-End: 90-718
tttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaa

SEQ ID NO: 179408 - DNA, 1594 bp, Homo sapiens
  Payload ID: 15353
  Gene Symbol: SCRN3
  Gene Name: secernin 3
  ENST ID: ENST00000548868
  CDS Start-End: 98-451
atcaaaggtgacagcttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatat

SEQ ID NO: 179409 - DNA, 1553 bp, Homo sapiens
  Payload ID: 15353
  Gene Symbol: SCRN3
  Gene Name: secernin 3
  ENST ID: ENST00000610561
  CDS Start-End: 50-1339
ccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcagg

SEQ ID NO: 179410 - DNA, 3320 bp, Homo sapiens
  Payload ID: 15354
  Gene Symbol: SECISBP2
  Gene Name: SECIS binding protein 2
  Uniprot ID: Q96T21
  ENST ID: ENST00000339901
  CDS Start-End: 157-2502
ggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagaaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaa

SEQ ID NO: 179411 - DNA, 3462 bp, Homo sapiens
  Payload ID: 15354
  Gene Symbol: SECISBP2
  Gene Name: SECIS binding protein 2
  Uniprot ID: Q96T21
  ENST ID: ENST00000375807
  CDS Start-End: 72-2636
gctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgttt

SEQ ID NO: 179412 - DNA, 547 bp, Homo sapiens
  Payload ID: 15354
  Gene Symbol: SECISBP2
  Gene Name: SECIS binding protein 2
  ENST ID: ENST00000440898
  CDS Start-End: 367-547
gctgcttccaagttgtggcagttatgagtaaagctgctataaacatccatgtgcaggtttttgtgtggacataagttttcacctcctttggataattaccaaggagtgcagtggctaaatcatatggtaagagtatggttagttttgtaaggaattgctaaactattaaatatctcccaaagtggctgtaacgtttttcattcttaccagcaatggataaggatttctgttgtcaaagtgttctggattttgatatgtagtgttatctccttgttttaatttgcatttctctgatgacatctaatgtgtttgctttttagggtgaaatagtggtgaaaaataacccaaatgaatctgtaactgctaatgccgctaccaattctccttcatgtacaagagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaa

SEQ ID NO: 179413 - DNA, 826 bp, Homo sapiens
  Payload ID: 15354
  Gene Symbol: SECISBP2
  Gene Name: SECIS binding protein 2
  ENST ID: ENST00000425851
  CDS Start-End: 1-826
ggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcag

SEQ ID NO: 179414 - DNA, 3584 bp, Homo sapiens
  Payload ID: 15354
  Gene Symbol: SECISBP2
  Gene Name: SECIS binding protein 2
  Uniprot ID: Q96T21
  ENST ID: ENST00000534113
  CDS Start-End: 386-2746
acccagcgcagtgactgcggcccagcccggcgctccccgcagtcggggcggggggactctggcgagcttcccgcgctcttgggaacggatagattgttttaaaggatcctgcgtttttctgaacgtcattctccgctctacgtactcagcattaccactagatggagccctggcgatcgcttgcatcatttttagacccataaaattctcggtgaaaggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgtttcagactctggtg

SEQ ID NO: 179415 - DNA, 6779 bp, Homo sapiens
  Payload ID: 15355
  Gene Symbol: SECISBP2L
  Gene Name: SECIS binding protein 2-like
  Uniprot ID: Q93073
  ENST ID: ENST00000261847
  CDS Start-End: 135-3305
aatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacaacccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatg

SEQ ID NO: 179416 - DNA, 2551 bp, Homo sapiens
  Payload ID: 15355
  Gene Symbol: SECISBP2L
  Gene Name: SECIS binding protein 2-like
  ENST ID: ENST00000380927
  CDS Start-End: 660-2551
agtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaataggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagt

SEQ ID NO: 179417 - DNA, 1084 bp, Homo sapiens
  Payload ID: 15355
  Gene Symbol: SECISBP2L
  Gene Name: SECIS binding protein 2-like
  ENST ID: ENST00000559424
  CDS Start-End: 149-1084
cagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagtt

SEQ ID NO: 179418 - DNA, 7176 bp, Homo sapiens
  Payload ID: 15355
  Gene Symbol: SECISBP2L
  Gene Name: SECIS binding protein 2-like
  Uniprot ID: Q93073
  ENST ID: ENST00000559471
  CDS Start-End: 265-3570
atttctaactacgcctccagcccattcgggccctcctcggcttccgtcccagatgatccctccccgaagctgccaccgcctcctccatctcccggagctggagccgcctcctcggccagtggcgtagccgaatcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatggaagtgtttctggtgtggaaccaactccaattcccagctacctgattacttgttacccatttgtgcaggaaaaccagtccaatagacagtttcctttatataacaatgatatacgatggcaacaacccaatccaaaccctactggaccatactttgcctatcccattatatctgctcagccgcctgtttctacagagtatacatattatcagctgatgccagcaccatgtgcccaggttatgggtttctatcatccttttcctacaccttactccaacacctttcaggctgcaaatactgtaaatgctatcaccacagaatgcactgagcgtccaagtcagcttggacaggtcttcccattgtccagccatcgaagcagaaacagtaacagaggatcagtggtcccaaaacaacagcttttacaacagcacataaaaagcaaaaggccgctggtgaaaaatgtagctactcagaaagaaacaaatgcagcaggtcctgatagtcgatcaaaaattgtgcttctggtagatgcttcacagcaaactgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagcctgcagcaggggctttgagaaatcctgattctgggaccatgaatcatgtggaatcatctatgtgtgcaggtggtgtaaattggtccaatgtaacttgccaggcaactcagaaaaaaccttggatggaaaaaaatcagacattttctagaggtggaaggcaaactgaacaaagaaataattcacaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacagtggttactgcagcttcttttcacactaaagactctactaatagaaaacctttaaccaaaagtcagccctgtttgacatcctttaattctgtggacattgcttcttctaaagcaaaaaaaggaaaagagaaggaaattgcaaaactaaaacgacccacagcacttaaaaaggttattttaaaagaaagagaggaaaagaaggggcgcttaactgtggaccacaatcttttgggatccgaggaaccaacagaaatgcacttagattttattgatgacttgccacaggagattgtttcccaggaagatactggactaagcatgcccagtgatacttcactctctccagcaagtcagaactctccatactgtatgacacctgtgtcacaaggctctcctgctagttctggaataggcagtccaatggcatcttcaacaataaccaaaatccacagcaaaagatttagagagtattgtaatcaggttctttgtaaagagattgatgaatgtgtgactcttcttctccaagagcttgtcagtttccaggaacgcatctaccaaaaagatcctgtaagagcaaaagcaaggagacgactcgttatgggtctaagagaagttaccaaacatatgaagttaaacaagatcaagtgtgttataatttctccaaactgtgaaaaaatccagtcaaaaggtggtctggatgaggctctctataatgttatagccatggcacgggaacaagaaattccttttgtgtttgcccttggaaggaaagctctaggacgctgtgtgaacaagctggttcctgttagcgtagtgggaatcttcaactactttggtgctgagagcctgtttaataaattagtagaactcactgaggaggccaggaaagcatataaagatatggttgcagcaatggaacaggagcaggctgaggaagccttaaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattggtaagcagccatcattagtggctacaggcagtactacctcagctacaagtgctgggaaatccacagcaagtgataaagaggaagtgaagccagatgacctggaatgggcctcacagcagagtacagagactggctctttggatggcagttgccgagatcttttgaattcctccatcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggaccatagcctttttatgagacaggtcacctctagaggacaacccaagaattattaaaggaaatgttaccattttgagagcatgcttaaataaatattaataatgtctttataacttgtttcctttaaattttggaatattgaattacaggctttggaggagttgtgaaaattaggaaagtttttatatattttttgaagtgggcatggttggctctttgaagacctataaagagatccagtgggaagagtaagggttggttcatcatcacaagaaataaaaaacatagtgattttttctcttaatgtgtagaggtggttttactggcaataattaataatagatttctatttcagtatgtaagcatattaactaaaatatgaattacacttccaaagttagatttctgcttcagtaggtttgtttgctgtgaagattacttctcaaaagacagatgttcatattagcttaattttcggtttaaatatgtttgtaaatgatgtaatatatttcttttgactaaatgtggaaaagtaatgtgtgttatacattgagaagtttttactggctttgactggaggttgtttttgcagagatggtattttatatgattccagtatttggaaaagaattagtcaaaaggaattcacatagtttaaatactgagaaattaatatccaaatatgtacttgtctgatttctaaataagctgggggaggagggaggggtgggaattgaaatgtgcaaatgagtagtgaatgctacactcattttcaactctttaacatgaaactgttcaatcttaacacattgttactttaatatatgtataaagaagtattactgtttgtaaagctgctgtttgcttaaaaaaaaaaaacacccttgtcatgtattttctgtatgttgggccaacaggttagaacatcaactcatttaaaaatttttatctttttttgatttaaaaaaattctgtgaaataatttatttacagacatcttcctcctccctcatcccttccaacctttacatacatcacagaatcaaccaaactgtttgcctaatctgaaatctgaatcctaatgagaaaaatttaaattttgttggcacatcacaccttgaaagtatttgtattattttataatttaatttctaaatataccacataagtttataatttaatgtcttaattgtaatgctctaataaaaaactagcaaaattagtgtgagttataacatgaagggattttcatcttttgctgtatgaaggataattgttatatcacatttggggggtaataacagcttttttgcactatgtaaatactagtggggattcttctgtactaataaaatgattattgaaatgaaa

SEQ ID NO: 179419 - DNA, 398 bp, Homo sapiens
  Payload ID: 15355
  Gene Symbol: SECISBP2L
  Gene Name: SECIS binding protein 2-like
  ENST ID: ENST00000561428
  CDS Start-End: 1-287
taaagaatgtgaagaaggtaccacaccacatgggacattctcggaatccctctgcagcaagtgccatttctttctgcagtgttatttctgaaccgatctctgaagtaaatgaaaaggaatatgaaacaaattggagaaacatggtggaaacttcagatggactggaagcatcagaaaatgagaaagaggtatcctgtaagcacagcacttctgaaaaacccagtaaacttccatttgacacacccccaattgagatacttcaagagttcatgactccccacaagtagaagacagaaaaaagagtccagcttgagtattgattggtggtcatatggagttgccaaaaaaggctgtaaaatcgtcacgaaggagttaagaataaaaatctccatctggga

SEQ ID NO: 179420 - DNA, 704 bp, Homo sapiens
  Payload ID: 15356
  Gene Symbol: SCGN
  Gene Name: secretagogin, EF-hand calcium binding protein
  ENST ID: ENST00000334979
  CDS Start-End: 1-150
atggacagctcccgggaaccgactctggggcgcttggacgccgctggcttctggcaggtctggcagcgctttgatgcggatggacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataa

SEQ ID NO: 179421 - DNA, 1447 bp, Homo sapiens
  Payload ID: 15356
  Gene Symbol: SCGN
  Gene Name: secretagogin, EF-hand calcium binding protein
  Uniprot ID: O76038
  ENST ID: ENST00000377961
  CDS Start-End: 169-999
cagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattggaaacaaaaa

SEQ ID NO: 179422 - DNA, 1402 bp, Homo sapiens
  Payload ID: 15356
  Gene Symbol: SCGN
  Gene Name: secretagogin, EF-hand calcium binding protein
  ENST ID: ENST00000612225
  CDS Start-End: 204-353
cagccgctggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatggacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattgg

SEQ ID NO: 179423 - DNA, 2235 bp, Homo sapiens
  Payload ID: 15357
  Gene Symbol: SECTM1
  Gene Name: secreted and transmembrane 1
  Uniprot ID: Q8WVN6
  ENST ID: ENST00000269389
  CDS Start-End: 352-1098
aggcacgaactctcctggaaaaatgctcccggcggctttcctgcttcctttagcgtgaaccgcgggtgcggtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcagggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 179424 - DNA, 583 bp, Homo sapiens
  Payload ID: 15357
  Gene Symbol: SECTM1
  Gene Name: secreted and transmembrane 1
  ENST ID: ENST00000582290
  CDS Start-End: 328-583
cattttcctggggctccggggcgcggagaagctgcatcccagaggagcgcgtccaggagcggacccgaagggactggacttgtactgagcatagcggctgcctggagtggggaacccagacctcaggacacggcacccgcagcctgcgccaatgtgggaccatccctgagcctcagcagcacctcggggttggtgacgtgcctcccagcagtgacagtgtccccacacctgcactctgcggctggcagggtcttccacgtggaggcaggaccatgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctact

SEQ ID NO: 179425 - DNA, 556 bp, Homo sapiens
  Payload ID: 15357
  Gene Symbol: SECTM1
  Gene Name: secreted and transmembrane 1
  ENST ID: ENST00000583093
  CDS Start-End: 117-556
tttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcagaaccccgaggcctgaaggaccgggccagcgcgcagct

SEQ ID NO: 179426 - DNA, 841 bp, Homo sapiens
  Payload ID: 15357
  Gene Symbol: SECTM1
  Gene Name: secreted and transmembrane 1
  ENST ID: ENST00000581691
  CDS Start-End: 306-841
acagactcgaggcctccaggagcggagccaaacagccccgcggggaacgcgcgccgcacgcgagctggacccgcccaggcacgaactctcctggaaaaatgctcccggcggctttcctgcttcctttagcgtgaaccgcgggtgcggtgcctcccgtgaaaataataaattcaccgtcacgcttgttgtgaacgcgggtggttcccgaaacttggaggcttcccgtaaacccagctccttcctcatctgggagggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccggga

SEQ ID NO: 179427 - DNA, 637 bp, Homo sapiens
  Payload ID: 15357
  Gene Symbol: SECTM1
  Gene Name: secreted and transmembrane 1
  ENST ID: ENST00000582563
  CDS Start-End: 128-637
tttcattttcctggggctccggggcgcggagaagctgcatcccagaggagcgcgtccaggagcggacccggtgagggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcagaaccccgaggcctgaaggaccgggccagcgcgcagctcctgggacctggcacatccaggggtgcagaaccccagtccgcccccgacactgggttctggcctgtgcca

SEQ ID NO: 179428 - DNA, 1030 bp, Homo sapiens
  Payload ID: 15357
  Gene Symbol: SECTM1
  Gene Name: secreted and transmembrane 1
  ENST ID: ENST00000580437
  CDS Start-End: 116-565
ttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaa

SEQ ID NO: 179429 - DNA, 787 bp, Homo sapiens
  Payload ID: 15357
  Gene Symbol: SECTM1
  Gene Name: secreted and transmembrane 1
  ENST ID: ENST00000581864
  CDS Start-End: 102-233
gggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgcc

SEQ ID NO: 179430 - DNA, 561 bp, Homo sapiens
  Payload ID: 15357
  Gene Symbol: SECTM1
  Gene Name: secreted and transmembrane 1
  ENST ID: ENST00000581954
  CDS Start-End: 430-561
tgtgcaaggctgagctcctgcgtggaggcaggtggggctttgtggagcttccacacagggaccctcatcccccagccactctcaggggatccagatccacacggatccagcacctcctgtatgcagggcatgagtggggaccccgtgggaagcacagaagcggcgacctcgctggggcctgtgagaggctcatcactgcctgtggggccctcccccagcaccgtgggtgtgtgccctggagccgcctctgcctggcgggagaggagccacacagctagggggcccctagtgtttgcaggcctgagacaagatggcacaaggaggctcgcctgctggaagctgcccagcagcctgccttgccagtgagagcagcagagggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctct

SEQ ID NO: 179431 - DNA, 4492 bp, Homo sapiens
  Payload ID: 15358
  Gene Symbol: SFRP1
  Gene Name: secreted frizzled-related protein 1
  Uniprot ID: Q8N474
  ENST ID: ENST00000220772
  CDS Start-End: 339-1283
cgagggctcggccgtaggagccccgcgcactccagccctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgat

SEQ ID NO: 179432 - DNA, 3873 bp, Homo sapiens
  Payload ID: 15358
  Gene Symbol: SFRP1
  Gene Name: secreted frizzled-related protein 1
  ENST ID: ENST00000379845
  CDS Start-End: 134-670
agacatgagtggacaccttagggggctcggctgcggaaaaggtgctgcagtccacagggaacatggggggattggacgggttgcctgaagaagagaggaaagaatccctcaccccagcccccaaaaggctgtgatgggatggggaaaccccataatcgctgtcttccggacaccttttgccccttggctgcagttccactggtcggcgcccttctcagcctggcttggaaccgtcctcactcacctccactcctcccagcagcgctcaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatc

SEQ ID NO: 179433 - DNA, 2032 bp, Homo sapiens
  Payload ID: 15359
  Gene Symbol: SFRP2
  Gene Name: secreted frizzled-related protein 2
  Uniprot ID: Q96HF1
  ENST ID: ENST00000274063
  CDS Start-End: 286-1173
agatttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacct

SEQ ID NO: 179434 - DNA, 849 bp, Homo sapiens
  Payload ID: 15360
  Gene Symbol: SFRP4
  Gene Name: secreted frizzled-related protein 4
  ENST ID: ENST00000447200
  CDS Start-End: 439-849
ctgattttcagatttttaaatcatttttatttgtgcacggctttactttcttttcaccattctctggatatgatagctaaaactggactctactccctggatgtgggtagactatgtaaggtctactgtctcctcactatatttaggtacatatctgtcattatgattttccagtctgacatgtaaagagcttggaagtcatcactcatcttctcacaaaaagacaaaaactgaacaaactgaaaatcaacaactcttcttagaggcatcagataattgagagcagaccgctgctgcaaacactggagagagagtcagatactaagaatcatagtttacaggagctgaagctgaggagcagaagccagaggctggagccggtgctgtgaagaaggctggcagacaacagtcaatcaggtgatcaaagtgaacatcaggatgcaattggaacagagtattatccctgatattcctgccaaagatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgc
